US011753458B2

(12) United States Patent
Evans et al.

(10) Patent No.: US 11,753,458 B2
(45) Date of Patent: Sep. 12, 2023

(54) CTLA-4 VARIANT IMMUNOMODULATORY PROTEINS AND USES THEREOF

(71) Applicant: Alpine Immune Sciences, Inc., Seattle, WA (US)

(72) Inventors: Lawrence Evans, Seattle, WA (US); Joseph L. Kuijper, Seattle, WA (US); Ryan Swanson, Seattle, WA (US)

(73) Assignee: Alpine Immune Sciences, Inc., Seattle, WA (US)

( * ) Notice: Subject to any disclaimer, the term of this patent is extended or adjusted under 35 U.S.C. 154(b) by 495 days.

(21) Appl. No.: 16/755,072

(22) PCT Filed: Oct. 9, 2018

(86) PCT No.: PCT/US2018/055095

§ 371 (c)(1),
(2) Date: Apr. 9, 2020

(87) PCT Pub. No.: WO2019/074983

PCT Pub. Date: Apr. 18, 2019

(65) Prior Publication Data

US 2020/0308249 A1 Oct. 1, 2020

Related U.S. Application Data

(60) Provisional application No. 62/733,615, filed on Sep. 19, 2018, provisional application No. 62/613,379, filed on Jan. 3, 2018, provisional application No. 62/570,619, filed on Oct. 10, 2017.

(51) Int. Cl.

| | |
|---|---|
| ***C07K 14/705*** | (2006.01) |
| ***A61K 47/65*** | (2017.01) |
| ***A61P 19/02*** | (2006.01) |
| ***A61K 35/17*** | (2015.01) |
| ***C07K 14/725*** | (2006.01) |
| ***C12N 5/0783*** | (2010.01) |
| ***C12N 15/00*** | (2006.01) |

(52) U.S. Cl.

CPC ........ *C07K 14/70521* (2013.01); *A61K 35/17* (2013.01); *A61K 47/65* (2017.08); *A61P 19/02* (2018.01); *C07K 14/7051* (2013.01); *C12N 5/0637* (2013.01); *C12N 15/00* (2013.01); *C07K 2319/02* (2013.01); *C07K 2319/03* (2013.01); *C07K 2319/30* (2013.01)

(58) Field of Classification Search

None

See application file for complete search history.

(56) References Cited

U.S. PATENT DOCUMENTS

| | | | |
|---|---|---|---|
| 4,751,180 | A | 6/1988 | Cousens |
| 4,935,233 | A | 6/1990 | Bell et al. |
| 5,168,062 | A | 12/1992 | Stinski |
| 5,208,020 | A | 5/1993 | Chari et al. |
| 5,283,173 | A | 2/1994 | Fields et al. |
| 5,385,839 | A | 1/1995 | Stinski |
| 5,434,131 | A | 7/1995 | Linsley et al. |
| 5,443,964 | A | 8/1995 | Pickup et al. |
| 5,468,614 | A | 11/1995 | Fields et al. |
| 5,500,362 | A | 3/1996 | Robinson et al. |
| 5,624,821 | A | 4/1997 | Winter et al. |
| 5,641,870 | A | 6/1997 | Rinderknecht et al. |
| 5,648,260 | A | 7/1997 | Winter et al. |
| 5,698,530 | A | 12/1997 | Schlom et al. |
| 5,731,168 | A | 3/1998 | Carter et al. |
| 5,767,071 | A | 6/1998 | Palladino et al. |
| 5,773,253 | A | 6/1998 | Linsley et al. |
| 5,780,426 | A | 7/1998 | Palladino et al. |
| 5,821,337 | A | 10/1998 | Carter et al. |
| 5,844,095 | A | 12/1998 | Linsley et al. |
| 5,851,795 | A | 12/1998 | Linsley et al. |
| 5,885,579 | A | 3/1999 | Linsley et al. |
| 5,885,796 | A | 3/1999 | Linsley et al. |
| 5,998,205 | A | 12/1999 | Hallenbeck et al. |
| 6,143,290 | A | 11/2000 | Zhang et al. |
| 6,194,551 | B1 | 2/2001 | Idusogie et al. |
| 6,365,619 | B1 | 4/2002 | Shi |
| 6,444,792 | B1 | 9/2002 | Gray et al. |
| 6,482,919 | B2 | 11/2002 | Ledbetter et al. |
| 6,596,535 | B1 | 7/2003 | Carter |
| 6,623,940 | B1 | 9/2003 | Ledbetter et al. |
| 6,685,941 | B1 | 2/2004 | Thompson et al. |
| 6,737,056 | B1 | 5/2004 | Presta |
| 6,750,334 | B1 | 6/2004 | Gray et al. |
| 6,855,317 | B2 | 2/2005 | Koelle et al. |
| 6,887,471 | B1 | 5/2005 | Linsley et al. |
| 6,936,257 | B1 | 8/2005 | Bennett |
| 6,998,252 | B1 | 2/2006 | Moss et al. |
| 7,094,874 | B2 | 8/2006 | Peach et al. |
| 7,094,875 | B2 | 8/2006 | Punnonen et al. |
| 7,105,166 | B1 | 9/2006 | Linsley et al. |
| 7,125,717 | B2 | 10/2006 | Carter |

(Continued)

FOREIGN PATENT DOCUMENTS

| | | |
|---|---|---|
| EP | 0757099 | 2/1997 |
| EP | 1248802 | 10/2002 |

(Continued)

OTHER PUBLICATIONS

Mkaddem et al. "Understanding Fc Receptor Involvement in Inflammatory Diseases: From Mechanisms to New Therapeutic Tools" Frontiers in Immunology 10:811 (Year: 2019).*

(Continued)

*Primary Examiner* — Sudhakar Katakam
*Assistant Examiner* — Zachary J Miknis
(74) *Attorney, Agent, or Firm* — COOLEY, LLP

(57) ABSTRACT

Provided herein are variant CTLA-4 polypeptides and immunomodulatory proteins and nucleic acids encoding such proteins. The immunomodulatory proteins provide therapeutic utility for a variety of disease applications, including for treatment of autoimmune or inflammatory conditions. Compositions and methods for making and using such proteins are provided.

31 Claims, 9 Drawing Sheets

Specification includes a Sequence Listing.

(56) References Cited

U.S. PATENT DOCUMENTS 7,247,615 B2 7/2007 Schlom et al.
7,304,033 B2 12/2007 Larsen et al.
7,307,064 B2 12/2007 Rusnak
7,332,303 B2 2/2008 Schilling et al.
7,332,581 B2 2/2008 Presta
7,368,116 B2 5/2008 Schlom et al.
7,371,826 B2 5/2008 Presta
7,378,087 B2 5/2008 Jefferies et al.
7,439,230 B2 10/2008 Peach et al.
7,455,835 B2 11/2008 Cohen et al.
7,482,327 B2 1/2009 Hagerty et al.
7,521,532 B2 4/2009 Dunussi-Joannopoulos et al.
7,550,296 B2 6/2009 Hermiston et al.
7,563,869 B2 7/2009 Honjo et al.
7,569,663 B2 8/2009 Tykocinski et al.
7,588,767 B2 9/2009 Szalay et al.
7,588,771 B2 9/2009 Szalay et al.
7,655,439 B2 2/2010 Moore et al.
7,662,398 B2 2/2010 Szalay et al.
7,670,602 B2 3/2010 Chung et al.
7,671,022 B2 3/2010 Rusnak
7,700,556 B2 4/2010 Peach et al.
7,722,868 B2 5/2010 Cohen et al.
7,754,221 B2 7/2010 Szalay et al.
7,794,718 B2 9/2010 Karrer et al.
7,829,534 B2 11/2010 Larsen et al.
7,915,222 B2 3/2011 Vratsanos et al.
7,915,395 B2 3/2011 Ledbetter et al.
8,071,095 B2 12/2011 Karrer et al.
8,088,736 B2 1/2012 Franks et al.
8,148,332 B2 4/2012 Cohen et al.
8,227,420 B2 7/2012 Cohen et al.
8,268,587 B2 9/2012 Karrer et al.
8,283,447 B2 10/2012 Karrer et al.
8,318,176 B2 11/2012 Karrer et al.
8,329,867 B2 12/2012 Lazar et al.
8,435,952 B2 5/2013 Vratsanos et al.
8,445,230 B2 5/2013 Karrer et al.
8,491,899 B2 7/2013 Karrer et al.
8,496,935 B2 7/2013 Karrer et al.
8,497,247 B2 7/2013 Cohen et al.
8,609,625 B2 12/2013 Lan et al.
8,624,010 B1 1/2014 Yoshinaga
8,629,119 B2 1/2014 Olson et al.
8,642,557 B2 2/2014 Akamatsu et al.
8,703,718 B2 4/2014 Cohen et al.
8,709,417 B2 4/2014 Allison et al.
8,722,632 B2 5/2014 Cohen et al.
8,785,398 B2 7/2014 Peach et al.
8,883,971 B2 11/2014 Akamatsu et al.
8,911,726 B2 12/2014 Takahashi et al.
8,956,619 B2 2/2015 Ostrand-Rosenberg
9,012,408 B2 4/2015 Vratsanos et al.
9,103,831 B2 8/2015 O'Sullivan et al.
9,289,480 B2 3/2016 Lan et al.
9,296,808 B2 3/2016 Cohen et al.
9,327,014 B2 5/2016 Gurney et al.
9,375,475 B2 6/2016 Allison et al.
9,453,227 B2 9/2016 Diamond et al.
9,540,426 B2 1/2017 Jing et al.
9,587,007 B2 3/2017 Akamatsu et al.
9,758,565 B2 9/2017 Peach et al.
9,884,902 B2 * 2/2018 Minter .................... A61P 19/02
10,882,914 B2 1/2021 Swanson et al.
11,078,282 B2 8/2021 Swanson et al.
11,096,988 B2 8/2021 Swanson et al.
11,117,948 B2 9/2021 Swanson et al.
11,117,949 B2 9/2021 Swanson et al.
11,117,950 B2 9/2021 Swanson et al.
11,319,359 B2 5/2022 Swanson et al.
2002/0009454 A1 1/2002 Boone et al.
2002/0168714 A1 11/2002 Barbas et al.
2003/0083246 A1 5/2003 Cohen et al.
2003/0138881 A1 7/2003 Punnonen et al.
2004/0063094 A1 4/2004 Coffin et al.
2004/0072283 A1 4/2004 Seed et al.
2004/0146488 A1 7/2004 Hu et al.
2005/0014934 A1 1/2005 Hinton et al.
2007/0202572 A1 8/2007 Szalay et al.
2007/0212727 A1 9/2007 Szalay et al.
2009/0053244 A1 2/2009 Chen et al.
2009/0098529 A1 4/2009 Chen et al.
2009/0117034 A1 5/2009 Chen et al.
2009/0136917 A1 5/2009 Szalay et al.
2009/0155287 A1 6/2009 Chen et al.
2009/0162288 A1 6/2009 Chen et al.
2009/0252749 A1 10/2009 Leister et al.
2009/0258031 A1 10/2009 Karrer et al.
2010/0062016 A1 3/2010 Szalay et al.
2010/0178276 A1 7/2010 Sadelain et al.
2010/0196325 A1 8/2010 Szalay et al.
2010/0233078 A1 9/2010 Szalay et al.
2010/0261660 A1 10/2010 Punnonen et al.
2011/0064650 A1 3/2011 Szalay
2011/0293705 A1 12/2011 Irvine et al.
2013/0149305 A1 6/2013 Ostrand-Rosenberg
2013/0287748 A1 10/2013 June et al.
2014/0011370 A1 1/2014 Camphausen
2014/0050708 A1 2/2014 Powell et al.
2014/0056890 A1 2/2014 Gurney et al.
2014/0099309 A1 4/2014 Powell et al.
2014/0154216 A1 6/2014 Coffin
2014/0186380 A1 7/2014 Gurney
2014/0186401 A1 7/2014 Diamond et al.
2014/0227237 A1 8/2014 June et al.
2014/0322129 A1 10/2014 Leong et al.
2014/0348832 A1 11/2014 Zhu et al.
2015/0104451 A1 4/2015 Orban
2015/0216970 A1 8/2015 Grogan et al.
2015/0232532 A1 8/2015 Ostrand-Rosenberg
2015/0359909 A1 12/2015 O'Sullivan et al.
2016/0017018 A1 1/2016 Wang et al.
2016/0017041 A1 1/2016 Violette et al.
2016/0145344 A1 5/2016 Akbari
2016/0158318 A1 6/2016 Cohen et al.
2016/0244524 A1 8/2016 Allison et al.
2016/0264643 A1 9/2016 Lazar et al.
2016/0271218 A1 9/2016 Biro
2016/0340422 A1 11/2016 Chen et al.
2016/0346368 A1 12/2016 Gurney et al.
2017/0028040 A1 2/2017 Lan et al.
2017/0042972 A1 2/2017 Karyekar
2017/0081387 A1 3/2017 Cai et al.
2017/0320959 A1 11/2017 Swanson et al.
2017/0369549 A1 12/2017 Peach et al.
2018/0118805 A1 5/2018 Bernett et al.
2018/0244749 A1 8/2018 Swanson et al.
2018/0256644 A1 9/2018 Swanson et al.
2018/0319861 A1 11/2018 Lan et al.
2020/0040059 A1 2/2020 Swanson et al.
2020/0283500 A1 9/2020 Lawrence et al.
2021/0130436 A1 5/2021 Swanson et al.
2021/0130437 A1 5/2021 Swanson et al.
2021/0155668 A1 5/2021 Swanson et al.
2021/0155669 A1 5/2021 Swanson et al.
2021/0163571 A1 6/2021 Swanson et al.
2021/0171603 A1 6/2021 Swanson et al.
2021/0188942 A1 6/2021 Swanson et al.
2021/0253668 A1 8/2021 Swanson et al.
2021/0347897 A1 11/2021 Swanson et al.
2021/0363219 A1 11/2021 Swanson et al.
2022/0242930 A1 8/2022 Swanson et al.
2022/0372106 A1 11/2022 Swanson et al.
2023/0101432 A1 3/2023 Swanson

FOREIGN PATENT DOCUMENTS

EP 3020816 5/2016
WO WO-1994/029351 12/1994
WO WO-1998/050431 11/1998
WO WO-1999/002711 1/1999
WO WO-1999/038955 8/1999
WO WO-1999/051642 10/1999
WO WO-2000/042072 7/2000

(56) References Cited

FOREIGN PATENT DOCUMENTS

| | | | |
|---|---|---|---|
| WO | WO-2001/030843 | 5/2001 | |
| WO | WO-2002/000717 | 1/2002 | |
| WO | WO-2004/056312 | 7/2004 | |
| WO | WO-2005/063816 | 7/2005 | |
| WO | WO-2005/100402 | 10/2005 | |
| WO | WO-2006/019447 | 2/2006 | |
| WO | WO-2006/029879 | 3/2006 | |
| WO | WO-2006/073941 | 7/2006 | |
| WO | WO-2007/029879 | 3/2007 | |
| WO | WO-2007/052029 | 5/2007 | |
| WO | WO-2008/047150 | 4/2008 | |
| WO | WO-2008/092117 | 7/2008 | |
| WO | WO-2009/029342 | 3/2009 | |
| WO | WO-2009/067800 | 6/2009 | |
| WO | WO-2009/076524 | 6/2009 | |
| WO | WO-2009/126688 | 10/2009 | |
| WO | WO-2011/020024 | 2/2011 | |
| WO | WO-2011/056983 | 5/2011 | |
| WO | WO-2011/097477 | 8/2011 | |
| WO | WO-2011/103584 | 8/2011 | |
| WO | WO-2011/109789 | 9/2011 | |
| WO | WO-2011/113019 | 9/2011 | |
| WO | WO-2011113019 A2 * | 9/2011 | ............ A61K 47/64 |
| WO | WO-2011/133886 | 10/2011 | |
| WO | WO-2012/079000 | 6/2012 | |
| WO | WO-2012/125850 | 9/2012 | |
| WO | WO-2012/141984 | 10/2012 | |
| WO | WO-2012/149364 | 11/2012 | |
| WO | WO-2013/003761 | 1/2013 | |
| WO | WO-2013/041029 | 3/2013 | |
| WO | WO-2013/148049 | 10/2013 | |
| WO | WO-2013/169338 | 11/2013 | |
| WO | WO-2013/184912 | 12/2013 | |
| WO | WO-2014/198002 | 12/2014 | |
| WO | WO-2014/207063 | 12/2014 | |
| WO | WO-2015/009856 | 1/2015 | |
| WO | WO-2015/107026 | 7/2015 | |
| WO | WO-2015/113494 | 8/2015 | |
| WO | WO 2015/120363 | 8/2015 | |
| WO | WO-2016/008976 | 1/2016 | |
| WO | WO-2016/011083 | 1/2016 | |
| WO | WO-2016/011264 | 1/2016 | |
| WO | WO-2016/191643 | 1/2016 | |
| WO | WO-2016/022994 | 2/2016 | |
| WO | WO 2016/034678 | 3/2016 | |
| WO | WO-2016/073704 | 5/2016 | |
| WO | WO-2016/118577 | 7/2016 | |
| WO | WO 2016/154684 | 10/2016 | |
| WO | WO-2016/168771 | 10/2016 | |
| WO | WO 2017/019846 | 2/2017 | |
| WO | WO-2017/023749 | 2/2017 | |
| WO | WO-2017/048878 | 3/2017 | |
| WO | WO-2017/106061 | 6/2017 | |
| WO | WO-2017/181148 | 10/2017 | |
| WO | WO-2017/181152 | 10/2017 | |
| WO | WO-2017/201131 | 11/2017 | |
| WO | WO-2018/022945 | 2/2018 | |
| WO | WO-2018/022946 | 2/2018 | |
| WO | WO-2018/075978 | 4/2018 | |
| WO | WO-2019/074983 | 4/2019 | |
| WO | WO-2019/136179 | 7/2019 | |
| WO | WO 2020/047329 | 3/2020 | |
| WO | WO-2021/226553 | 11/2021 | |

OTHER PUBLICATIONS

U.S. Appl. No. 16/959,662, filed Jan. 3, 2019, by Swanson et al.

Baban et al., "Bacteria as vectors for gene therapy of cancer," Bioeng Bugs. (2010) 1(6):385-394.

Benson et al., "GenBank," Nucleic Acids Res (2013) 41(Database issue):D36-D42.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Chang et al., "The discovery of small molecule carbamates as potent dual alpha(4)beta(1)/alpha(4)beta(7) integrin antagonists," Bioorg Med Chem Lett. Jan. 21, 2002;12(2):159-63.

Chari et al., "Immunoconjugates containing novel maytansinoids: promising anticancer drugs," Cancer Res. (1992) 52(1):127-131.

Clynes et al., "Fc receptors are required in passive and active immunity to melanoma," Proc Natl Acad Sci USA. (1998) 95(2):652-656.

Colby et al., "Engineering antibody affinity by yeast surface display," Methods Enzymol. 2004;388:348-58.

Colcher et al., "Use of monoclonal antibodies as radiopharmaceuticals for the Tocalization of human carcinoma xenografts in athymic mice," Methods Enzymol. (1986); 121: 802-16.

Condomines et al., "Tumor-Targeted Human T Cells Expressing CD28-Based Chimeric Antigen Receptors Circumvent CTLA-4 Inhibition," PLoS One (2015) 10(6):e0130518.

Cornetta et al., "No retroviremia or pathology in long-term follow-up of monkeys exposed to a murine amphotropic retrovirus," Hum GeneTher. (1991) Fall;2(3):215-9.

Cragg et al., "Complement-mediated lysis by anti-CD20 mAb correlates with segregation into lipid rafts," Blood. (2003) 101(3):1045-1052.

David et al., "Protein iodination with solid state lactoperoxidase," Biochemistry. Feb. 26, 1974;13(5):1014-21.

Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.

Duncan et al., "The binding site for C1q on IgG," Nature. Apr. 21, 1988;332(6166):738-40.

Engelman et al., "Multiple effects of mutations in human immunodeficiency virus type 1 integrase on viral replication," J Virol. 1995 69(5):2729-2736.

Ford et al., "Targeting co-stimulatory pathways: transplantation and autoimmunity," Nat Rev Nephrol. (2014) 10(1):14-24.

Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.

Freeman et al., "Engagement of the PD-1 immunoinhibitory receptor by a novel B7 family member leads to negative regulation of lymphocyte activation," J Exp Med (2000) 192(7):1027-1034.

Garcia-Aragoncillo et al., "Design of virotherapy for effective tumor treatment," Curr Opin Mol Ther. Aug. 2010;12(4):403-11.

Gazzano-Santoro et al., "A non-radioactive complement-dependent cytotoxicity assay for anti-CD20 monoclonal antibody," J Immunol Methods. Mar. 28, 1997;202(2):163-71.

Gherardi et al., "Recombinant poxviruses as mucosal vaccine vectors," J Gen Virol. (2005) 86(Pt 11):2925-2936.

Guerra et al., "Host response to the attenuated poxvirus vector NYVAC: upregulation of apoptotic genes and NF-kappaB-responsive genes in infected HeLa cells," J Virol. Jan. 2006;80(2):985-98.

Harris et al., "CD80 costimulation is essential for the induction of airway eosinophilia," J Exp Med. Jan. 6, 1997;185(1):177-82.

Hellstrom et al., "Antitumor effects of L6, an IgG2a antibody that reacts with most human carcinomas," Proc Natl Acad Sci U S A. (1986) 83(18):7059-7063.

Hellstrom et al., "Strong antitumor activities of IgG3 antibodies to a human melanoma-associated ganglioside," Proc Natl Acad Sci U S A. (1985) 82(5):1499-1502.

Hou et al., "Atransendocytosis model of CTLA-4 function predicts its suppressive behavior on regulatory T cells," J Immunol (2015) 194(5):2148-2159.

Hu et al., "Yaba-like disease virus: an alternative replicating poxvirus vector for cancer gene therapy," J Virol. (2001) 75(21):10300-10308.

(56) References Cited

OTHER PUBLICATIONS

Hunter et al., "Preparation of iodine-131 labelled human growth hormone of high specific activity," Nature. May 5, 1962;194:495-6.
Idusogie et al., "Mapping of the C1q binding site on rituxan, a chimeric antibody with a human IgG1 Fc," J Immunol. (2000) 164(8):4178-4184.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Kabat et al., "Sequences of Proteins of Immunological Interest," Fifth Edition, U.S. Department of Health and Human Services, NIH Publication No. 91-3242 (1991), 83 pages.
Kirn et al., "Targeted and armed oncolytic poxviruses: a novel multi-mechanistic therapeutic class for cancer," Nat Rev Cancer. Jan. 2009;9(1):64-71.
Kolberg, "Gene-transfer virus contaminant linked to monkey's cancer," J NIH Res. (1992) 4:43-44.
Kremer et al., "Treatment of rheumatoid arthritis by selective inhibition of T-cell activation with fusion protein CTLA4lg," N Engl J Med (2003) 349(20):1907-1915.
Labrijn et al., "Therapeutic IgG4 antibodies engage in Fab-arm exchange with endogenous human IgG4 in vivo," Nat Biotechnol. Aug. 2009;27(8):767-71.
Larsen et al., "Rational development of LEA29Y (belatacept), a high-affinity variant of CTLA4-Ig with potent immunosuppressive properties," Am J Transplant. Mar. 2005;5(3):443-53.
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Lin et al., "Specific and dual antagonists of alpha(4)beta(1) and alpha(4)beta(7) integrins," Bioorg Med Chem Lett. Jan. 21, 2002;12(2):133-6.
Linsley et al., "Human B7-1 (CD80) and B7-2 (CD86) bind with similar avidities but distinct kinetics to CD28 and CTLA-4 receptors," Immunity. Dec. 1994;1(9):793-801.
Mayr et al., "Passage history, properties, and applicability of the attenuated vaccinia virus strain MVA," Infection. (1975);3:6-14. (English translation of abstract provided).
McWilliams et al., "Mutations in the 5' end of the human immunodeficiency virus type 1 polypurine tract affect RNase H cleavage specificity and virus titer," J Virol. (2003) 77(20):11150-11157.
Merchant et al., "An efficient route to human bispecific IgG," Nat Biotechnol. Jul. 1998;16(7):677-81.
Mercier et al., "A chimeric adenovirus vector encoding reovirus attachment protein sigma1 targets cells expressing junctional adhesion molecule 1," Proc Natl Acad Sci U S A. (2004) 101(16):6188-6193.
Miller et al., "Construction and properties of retrovirus packaging cells based on gibbon ape leukemia virus," J Virol. (1991) 65(5):2220-2224.
Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively Yeplicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector," J Virol. (1998) 72(10):8150-8157.
Mizuhara et al., "T cell activation-associated hepatic injury: mediation by tumor necrosis factors and protection by interleukin 6," J Exp Med. 1994 179(5): 1529-1537.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human CD80 (B7-1) and CD86 (B7-2)," J Immunol. (1996) 156(3):1047-1054.
Narumi et al., "Adenovirus vector-mediated perforin expression driven by a glucocorticoid-inducible promoter inhibits tumor growth in vivo," Am J Respir Cell Mol Biol. (1998) 19(6):936-941.
Nightingale et al., "Transient gene expression by nonintegrating lentiviral vectors," Mol Ther. (2006) 13(6):1121-1132.
Nygren, "Conjugation of horseradish peroxidase to Fab fragments with different homobifunctional and heterobifunctional cross-linking reagents. A comparative study," J Histochem Cytochem. May 1982;30(5):407-12.
Oshima et al., "ASP2408 and ASP2409, novel CTLA4-Ig variants with CD86-selective Tigand binding activity and improved immunosuppressive potency, created by directed evolution," Protein Engineering, Design and Selection (2016) 29(5):159-167.
Pain et al., "Preparation of protein A-peroxidase monoconjugate using a heterobifunctional reagent, and its use in enzyme immunoassays," J Immunol Methods. (1981);40(2):219-30.
Patyar et al., "Bacteria in cancer therapy: a novel experimental strategy," J Biomed Sci. (2010) 17(1):21.
Peach et al., "Complementarity determining region 1 (CDR1)- and CDR3-analogous Yegions in CTLA-4 and CD28 determine the binding to B7-1," J Exp Med (1994) 180(6):2049-2058.
Peach et al., "Both extracellular immunoglobin-like domains of CD80 contain residues critical for binding T cell surface receptors CTLA-4 and CD28," J Biol Cherm. (1995) 270(36):21181-7.
Penix et al., "Two essential regulatory elements in the human interferon gamma promoter confer activation specific expression in T cells," J Exp Med. (1993) 178(5):1483-1496.
Peper et al., "An impedance-based cytotoxicity assay for real-time and label-free assessment of T-cell-mediated killing of adherent cells," J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgGl antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. Jun. 2007;18(6):483-9.
Powell et al., "Sequence and structural determinants required for priming of plus-strand DNA synthesis by the human immunodeficiency virus type 1 polypurine tract," J Virol. (1996) 70(8):5288-5296.
Qureshi et al., "Trans-endocytosis of CD80 and CD86: a molecular basis for the cell-extrinsic function of CTLA-4," Science (2011) 332(6029):600-603.
Ravetch et al., "Fc receptors," Annu Rev Immunol. (1991);9:457-92.
Ridgway et al., "'Knobs-into-holes' engineering of antibody CH3 domains for heavy chain heterodimerization," Protein Eng. Jul. 1996;9(7):617-21.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Seow et al., "Biological gene delivery vehicles: beyond viral vectors," Mol Ther. (2009) 17(5):767-777.
Shields et al., "High resolution mapping of the binding site on human IgGl for Fc gamma RI, Fc gamma RII, Fc gamma RIII, and FcRn and design of IgG1 variants with improved binding to the Fc gamma R," J Biol Chem. (2001) 276(9):6591-6604.
Sommerfelt et al., "Receptor interference groups of 20 retroviruses plating on human cells," Virology. May 1990;176(1):58-69.

(56) References Cited

OTHER PUBLICATIONS

Soskic et al., "Chapter Four—A Transendocytosis Perspective on the CD28/CTLA-4 Pathway," Advance in Immunology (2014) 124:95-136.
Srivastava et al., "Engineering CAR-T cells: Design Concepts," Trends in Immunology (2015) 36(8):494-502.
Stamper et al., "Crystal structure of the B7-1/CTLA-4 complex that inhibits human immune responses," Nature. (2001) 410(6828):608-611.
Strohl, "Optimization of Fc-mediated effector functions of monoclonal antibodies," Curr Opin Biotechnol. Dec. 2009; 20(6):685-91.
Tangney et al., "The use of Listeria monocytogenes as a DNA delivery vector for cancer gene therapy," Bioeng Bugs. (2010) 1(4):284-287.
Tartaglia et al., "Highly attenuated poxvirus vectors," AIDS Res Hum Retroviruses. (1992) 8(8):1445-1447.
Thompson et al., "cis-acting sequences required for inducible interleukin-2 enhancer function bind a novel Ets-related protein, Elf-1," Mol Cell Biol. (1992) 12(3):1043-1053.
Tiegs et al., "A T cell-dependent experimental liver injury in mice inducible by concanavalin A." J Clin Invest. (1992) 90(1): 196-203.
Todd et al., "Transcription of the interleukin 4 gene is regulated by multiple promoter elements," J Exp Med. (1993) 177(6):1663-1674.
Toyabe et al., "Requirement of IL-4 and liver NK1+ T cells for concanavalin A-induced hepatic injury in mice," J Immunol (1997) 159:1537-1542.
Van Pijkeren et al., "A novel Listeria monocytogenes-based DNA delivery system for cancer gene therapy," Hum Gene Ther. Apr. 2010;21(4):405-16.
Vitetta et al., "Redesigning nature's poisons to create anti-tumor reagents," Science. Nov. 20, 1987;238(4830):1098-104.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular modeling and functional mapping of B7-H1 and B7-DC uncouple costimulatory function from PD-1 interaction," J Exp Med. 2003 197(9):1083-91.
Wekerle et al., "Belatacept: from rational design to clinical application," Transplant International (2012) 25:139-150.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wu et al., "CTLA-4-B7 Interaction Is Sufficient to Costimulate T Cell Clonal Expansion," J. Exp. Med. (1997) 185(7):1327-1335.
Wu et al., "IL-24 modulates IFN-gamma expression in patients with tuberculosis," Immunol Lett. (2008) 117(1):57-62.
Xu et al., "Affinity and cross-reactivity engineering of CTLA4-Ig to modulate T cell costimulation," J Immunol (2012) 189(9):4470-4477.
Yao et al., "B7-h2 is a costimulatory ligand for CD28 in human," Immunity. (2011) 34(5):729-40.
Zhang et al., "An NKp30-Based Chimeric Anitgen Receptor Promotes T Cell Effector Functions and Antitumor Efficacy In Vivo," J Immunol (2012) 189:2290-2299.
Zhao et al., "A Bispecific Protein Capable of Engaging CTLA-4 and MHCII Protects Non-Obese Diabetic Mice from Autoimmune Diabetes," PLoS One (2013) 8(5):e63530-e63530.
Zhao et al., "Structural Design of Engineered Costimulation Determines Tumor Rejection Kinetics and Persistence of CAR T Cells," Cancer Cell (2015) 28(4):415-428.
Zhao et al., "TIGIT overexpression diminishes the function of CD4T cells and ameliorates the severity of rheumatoid arthritis in mouse models," Exp Cell Res. Jan. 1, 2016;340(1):132-8.
Zufferey et al., "Self-inactivating lentivirus vector for safe and efficient in vivo gene delivery," J Virol. (1998) 72(12):9873-9880.
Behr et al., "Trastuzumab and breast cancer," N Engl J Med.(2001) 345:995-996.
Biasini et al., "SWISS-MODEL: modelling protein tertiary and quaternary structure using evolutionary information," Nucleic Acids Res (2014) 42:W252-258.
Boder et al.. "Optimal screening of surface-displayed polypeptide libraries," Biotechnol Prog. (1998) 14:55-62.
Brandt et al., The B7 family member B7-H6 is a tumor cell ligand for the activating natural killer cell receptor NKp30 in humans. J Exp Med. (2009) 206:1495-1503.
Burmeister et al., ICOS controls the pool size of effector-memory and regulatory T cells. J Immunol.(2008) 180:774-82.
Carter et al., "Cytotoxic T-lymphocyte antigen-4 and programmed death-1 function as negative regulators of lymphocyte activation," Immunol Res (2003) 28:49-59.
Carter et al., "Humanization of an anti-pl85HER2 antibody for human cancer therapy," Proc Natl Acad Sci USA (1992) 89:4285-4289.
Chao et al., "Isolating and engineering human antibodies using yeast surface display," Nat Protoc. (2006) 1:755-768.
Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.
Derer et al., Complement in antibody-based tumor therapy. Crit Rev Immunol. (2014) 34:199-214.
Dull et al., "A Third-Generation Lentivirus Vector with a Conditional Packaging System," J Virology (1998) 72(11): 8463-8471.
Ellis et al., "Interactions of CD80 and CD86 with CD28 and CTLA4,"J Immunol (1996) 156:2700-2709.
Esensten et al., CD28 costimulation: from mechanism to therapy. Immunity. (2016) 44:973-988.
Evans et al.,"Generation of Novel Immuno-Oncology Biologies via Directed Evolution of Variant IgSF Domains," Poster Presentation for Immune Checkpoint Inhibitors, Boston, MA (Mar. 14-16, 2017) 1 page.
Evans et al., "Novel immunomodulatory proteins generated via directed evolution of variant IgSF domains," Abstract for AAI Immunology 2017, Washington D.C. (May 12-16, 2017) 1 page Published April A852017.
Evans et al., "Novel immunomodulatory proteins generated via directed evolution of variant IgSF domains," Poster for AAI Immunology 2017, Washington D.C. (May 12-16, 2017) 1 page.
Evans et al., "Therapeutic T Cell Activation Using Engineered Variant IgSF Domains," Abstract for Society for Immunotherapy of Cancer, National Harbor, MD, (Nov. 9-13, 2016) 1 page Published Nov. 8, 2016.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Gregoire-Gauthier et al., "Use of immunoglobulins in the prevention of GvHD in a xenogeneic NOD/SCID/gammac- mouse model," Bone Marrow Transplant (2012) 47:439-450.
Halaby et al., "The immunoglobulin superfamily: an insight on its tissular, species, and functional diversity," J Mol Evol (1998) 46:89-400.
Jenkins et al., "CD28 delivers a costimulatory signal involved in antigen-specific IL-2 production by human T cells," J Immunol. (1991) 147:2461-6.
Koenen et al., "A novel bispecific antihuman CD40/CD86 fusion protein with T-cell tolerizing potential," Transplantation (2004) 78(10):1429-1438.
Levin et al., "Novel Immunomodulatory Proteins Generated Via Directed Evolution of Variant IgSF Domains," Abstract for Keystone Symposia: Immune Regulation in Autoimmunity and Cancer, Whistler, British Columbia, Canada (Mar. 26-30, 2017), 1 page Available to Attendees Feb. 26, 2017.
Levin et al., "Novel Immunomodulatory Proteins Generated Via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.

(56) References Cited

OTHER PUBLICATIONS

Lewis et al., "Novel immunomodulatory proteins generated via directed evolution of variant IgSF domains," Abstract for Poster Presentation at the Federation of Clinical Immunology Societies Meeting, Chicago IL (Jun. 14, 2017) 2 pages Published after Apr. 7, 2017.
Lewis et al., "Novel immunomodulatory proteins generated via directed evolution of variant IgSF domains," Poster Presentation at the Federation of Clinical Immunology Societies Meeting, Chicago IL (Jun. 14, 2017).
Lundqvist et al., "31st Annual Meeting and Associated Programs of the Society for Immunotherapy of Cancer (SITC 2016): part one," J Immunother Cancer, (2016) 4(Suppl 1):82.
Lundqvist et al., "31st Annual Meeting and Associated Programs of the Society for Immunotherapy of Cancer (SITC 2016): part two," J Immunother Cancer, (2016) 4(Suppl 1):82.
Mease et al., "Efficacy and safety of abatacept, a T-cell modulator, in a randomised, double-blind, placebo-controlled, phase III study in psoriatic arthritis," Ann Rheum Dis. (2017) 76:1550-8.
Ochoa et al., "Antibody-dependent cell cytotoxicity: immunotherapy strategies enhancing effector NK cells," Immunol Cell Biol. (2017) 95:347-55.
Parslow et al., "Antibody-drug conjugates for cancer therapy," Biomedicines. (2016) 4:E32.
Rixon et al., "Novel Immunomodulatory Proteins Generated Via Directed Evolution of Variant IgSF Domains" PEGS: The Essential Protein Engineering Summit, Boston, MA, Apr. 30-May 1, 2018, 1 page. Abstract.
Rixon et al., "Novel Immunomodulatory Proteins Generated Via Directed Evolution of Variant IgSF Domains" PEGS: The Essential Protein Engineering Summit, Boston, MA, Apr. 30-May 1, 2018, 1 page. Presentation.
Ruperto et al., Abatacept in children with juvenile idiopathic arthritis: a randomised, double-blind, placebo-controlled withdrawal trial. Lancet. (2008) 372:383-391.
Sathish et al., "Challenges and approaches for the development of safer immunomodulatory biologies," Nature Reviews Drug Discovery (2013) 12(4):306-324.
Schilderg et al., "Coinhibitory Pathways in the B7-CD28 Ligand-Receptor Family," Immunity. (2016) 44(5): 955-72.
Scholten et al., "Promiscuous behavior of HPV16E6 specific T cell receptor beta chains hampers functional expression in TCR transgenic T cells, which can be restored in part by genetic modification," Cell Oncol. (2010) 32:43-56.
Topalian et al., "Safety, activity, and immune correlates of anti-PD-1 antibody in cancer," N engl J Med (2012) 366:2443-2454.
Van Der Merwe et al.. "CD80 (B7-1) binds both CD28 and CTLA-4 with a low affinity and very fast kinetics," J exp Med (1997) 185:393-403.
Mncenti et al., "Costimulation blockade with belatacept in renal transplantation," N Engl J Med. (2005) 353:770-81.
Weber et al., "ICOS maintains the T follicular helper cell phenotype by down-regulating Kruppel-like factor 2," J Exp Med. (2015) 212:217-33.
Wolchok et al., Development of ipilimumab: a novel immunotherapeutic approach for the treatment of advanced melanoma. Ann N Y Acad Sci. (2013) 1291:1-13.
Yoshinaga et al., cell co-stimulation through B7RP-1 and ICOS. Nature. (1999) 402:827-832.
Yu et al., "The role of B7-CD28 co-stimulation in tumor rejection," Int Imm (1998) 10(6):791-797.
U.S. Appl. No. 17/923,208, filed Nov. 3, 2022, by Dillon et al.
U.S. Appl. No. 18/161,799, filed Jan. 30, 2023, Evans et al.
"Database accession No. A0A2K5E9H6," Retrieved from UNIPROT, https://www.uniprot.org/uniprot/A0A2K5E9H6. Retrieved Sep. 13, 2019.
"Database accession No. A0A2K5Q1G1" Retrieved from UNIPROT, https://www.uniprot.org/uniprot/A0A2K5Q1G1.txt. Retrieved on Aug. 12, 2021.
Database accession No. AER57743 "Human B7Rp1 extracellular domain (ECD)" Dated Apr. 19, 2007.
"Database accession No. BDH56778", Retrieved from GENESEQ, Retrieved on Sep. 13, 2019.
"Database accession No. BDV07959," Retrieved from GENESEQ, Retrieved on Sep. 12, 2019.
"Database accession No. G3SBS5" Retrieved from UNIPROT, https://www.uniprot.org/uniprot/G3SBS5.txt. Retrieved on Aug. 12, 2021.
"Database accession No. A0A2J8M811," Retrieved from UNIPROT, https://www.uniprot.org /uniprot/A0A2J8M811. Retrieved on Mar. 5, 2020.
"Database accession No. H9Z6Y0," version 15. Retrieved from UNISAVE, http://www.ebi.ac.uk/uniprot/unisave/app/#/content/H9Z6Y0/15. Retrieved on Jun. 20, 2017.
"Database accession No. L8Y5K4," version 13. Retrieved from UNISAVE, http://www.ebi.ac.uk/uniprot/unisave/app/#/content/L8Y5K4/13. Retrieved on Sep. 28, 2017.
"Database accession No. NP_56074.1," version 1. Retrieved from NCBI, https://www.ncbi.nlm.nih.gov/protein /NP_056074.1, Retrieved on Mar. 3, 2020.
Adom et al., "ICOSL+ plasmacytoid dendritic cells as inducer of graft-versus-host disease, responsive to a dual ICOS/CD28 antagonist" Sci Transl Med. (2020) 12(564): eaay4799.
Amatore et al., "Inducible Co-Stimulator (ICOS) as a Potential Therapeutic Target for Anti-Cancer Therapy," Expert Opin Ther Targets. (2018) 22(4): 343-351.
Auffermann-Gretzinger et al., "Rapid establishment of dendritic cell chimerism in allogeneic hematopoietic cell transplant recipients," Blood. (2002) 99(4): 1442-1448.
Bachmann et al., "The EVH2 Domain of the Vasodilator-stimulated Phosphoprotein Mediates Tetramerization, F-actin Binding, and Actin Bundle Formation," J Biol Chem. (1999) 274(33):23549-23557.
Banovic et al., "Graft-versus-host disease prevents the maturation of plasmacytoid dendritic cells," J Immunol. (2009) 182(2): 912-920.
Covassin et al., "Human peripheral blood CD4 T cell-engrafted non-obese diabetic-scid IL2rγ(null) H2-Ab1 (tm1Gru) Tg (human leucocyte antigen D-related 4) mice: a mouse model of human allogeneic graft-versus-host disease," Clin Exp Immunol. 2011 166(2): 269-280.
Despoix et al., "Mouse CD146/MCAM is a marker of natural killer cell maturation", Eur J Immunol. (2008) 38(10): 2855-2864.
Ehx et al., "Xenogeneic Graft-Versus-Host Disease in Humanized NSG and NSG-HLA-A2/HHD Mice", Front Immunol. (2018) 9:1943.
European Search Report for Application No. 19704899.4 dated Jan. 11, 2022, 4 pages.
Ferrara et al., "Regenerating islet-derived 3-alpha is a biomarker of gastrointestinal graft-versus-host disease," Blood. (2011) 118(25): 6702-6708.
Forcade et al., "An activated Th17-prone T cell subset involved in chronic graft-versus-host disease sensitive to pharmacological inhibition," JCI Insight. (2017) 2(12): e92111.
Fowler et al., "R707, a fully human antibody directed against CC-chemokine receptor 7, attenuates xenogeneic acute graft-versus-host disease", Am J Transplant. (2019) 19(7): 1941-1954.
Gunasekaran et al., "Enhancing antibody Fc heterodimer formation through electrostatic steering effects: applications to bispecific molecules and monovalent IgG," J Biol Chem (2010) 285(25):19637-19646.
Hartwell et al., "An early-biomarker algorithm predicts lethal graft-versus-host disease and survival," JCI Insight. (2017) 2(3): e89798.
Hoseini et al., "A potent tetravalent T-cell-engaging bispecific antibody against CD33 in acute myeloid leukemia", Blood Adv. Jun. 12, 2018;2(11):1250-1258.
Huston et al., "Protein engineering of antibody binding sites: recovery of specific activity in an anti-digoxin single-chain Fv analogue produced in *Escherichia coli*," PNAS (1988) 85(16):5879-5883.
Jones et al., "Peripherally Induced Regulatory T Cells: Recruited Protectors of the Central Nervous System against Autoimmune Neuroinflammation," Front Immunol (2017) 8:532.

(56) References Cited

OTHER PUBLICATIONS

Kamphorst et al., "Rescue of exhausted CD8 T cells by PD-1-targeted therapies is CD28-dependent," Science (2017) 355(6332):1423-1427.
Kim et al., "Programmed cell death ligand 1 alleviates psoriatic inflammation by suppressing IL-17A production from programmed cell death 1 -high T cells," J Allergy Clin Immunol (2016) 137(5):1466-1476.
Koura et al., "In vivo T cell costimulation blockade with abatacept for acute graft-versus-host disease prevention: a first-in-disease trial", Biol Blood Marrow Transplant. (2013) 19(11): 1638-1649.
Koyama et al., "Plasmacytoid dendritic cells prime alloreactive T cells to mediate graft-versus-host disease as antigen-presenting cells," Blood. (2009) 113(9): 2088-2095.
Laouar et al., "STAT3 is required for Flt3L-dependent dendritic cell differentiation," Immunity. (2003) 19(6): 903-912.
Li et al., "Proteomics analysis reveals a Th17-prone cell population in presymptomatic graft-versus-host disease," JCI Insight. (2016) 1(6): e86660.
Markey et al., "Conventional dendritic cells are the critical donor APC presenting alloantigen after experimental bone marrow transplantation", Blood. 2009 113(22): 5644-5649.
Markey et al., "Flt-3L Expansion of Recipient CD8α + Dendritic Cells Deletes Alloreactive Donor T Cells and Represents an Alternative to Posttransplant Cyclophosphamide for the Prevention of GVHD", Clin Cancer Res. (2018) 24(7): 1604-1616.
Markey et al., "Recipient plasmacytoid DCs are not required to prime allogeneic T-cell responses after BMT," Blood. (2009) 113(23): 6038-6039.
Martin et al., "Increasingly frequent diagnosis of acute gastrointestinal graft-versus-host disease after allogeneic hematopoietic cell transplantation," Biol Blood Marrow Transplant. (2004) 10(5): 320-327.
Mataki et al., "Expression of PD-1, PD-L1, and PD-L2 in the Liver in Autoimmune Liver Diseases," Am J Gastroenterol (2007) 102:302-312.
Mauer et al., "ALPN-202, a variant CD80 vlgD™-Fc fusion protein, antagonizes PD-L1 and CTLA-4 and provides conditional CD28 agonism, eliciting potent anti-tumor immunity superior to checkpoint blockade" (Abstract) SITC 2019.
Maute et al., "Engineering high-affinity PD-1 variants for optimized immunotherapy and immuno-PET imaging," Proc Natl Acad Sci U S A. (2015) 112(47): E6506-14.
McDonald et al., "Plasma biomarkers of acute GVHD and nonrelapse mortality predictive value of measurements before GVHD onset and treatment," Blood. (2015) 126(1): 113-120.
Mezzadra et al., "Identification of CMTM6 and CMTM4 as PD-L1 protein regulators," Nature (2017) 549(7670):106-110.
Mochizuki et al., "Delta-like ligand 4 identifies a previously uncharacterized population of inflammatory dendritic cells that plays important roles in eliciting allogeneic T cell responses in mice," J Immunol. (2013) 190(7): 3772-82.
Newton et al., "Angiogenin Single-Chain Immunofusions: Influence of Peptide Linkers and Spacers between Fusion Protein Domains," Biochemistry (1996) 35(2):545-553.
Paczesny et al., "A biomarker panel for acute graft-versus-host disease," Blood. (2009) 113(2): 273-278.
Paczesny et al., "Elafin is a biomarker of graft-versus-host disease of the skin," Sci Transl Med. (2010) 2(13): 13ra2.
Paczesny, "Biomarkers for posttransplantation outcomes," Blood. (2018) 131(20): 2193-2204.
Patton et al., "Evaluation of the efficiency of human immune system reconstitution in NSG mice and NSG mice containing a human HLA.A2 transgene using hematopoietic stem cells purified from different sources", J Immunol Methods. (2015) 422: 13-21.
Paulos et al., "The inducible costimulator (ICOS) is critical for the development of human T(H)17 cells", Sci Transl Med. (2010) 2(55): 55ra78.
Ramadan et al., "From proteomics to discovery of first-in-class ST2 inhibitors active in vivo," JCI Insight. (2018) 3(14): e99208.
Ramos et al., "FMS-related tyrosine kinase 3 ligand (Flt3L)/CD135 axis in rheumatoid arthritis", Arthritis Res Ther. (2013) 15(6):R209.
Reizis et al., "Plasmacytoid Dendritic Cells: Development, Regulation, and Function," Immunity. (2019) 50(1): 37-50.
Ren et al., "The search for drug-targetable diagnostic, prognostic and predictive biomarkers in chronic graft-versus-host disease," Expert Rev Clin Immunol. (2018) 14(5): 389-404.
Rennert et al., "The IgV domain of human B7-2 (CD86) is sufficient to co-stimulate T Tymphocytes and induce cytokine secretion," International Immunology (1997) 9(6):805-813.
Rentero et al., "Screening of Large Molecule Diversities by Phage Display," Chimia (Aarau) (2011) 65(11): 843-845.
Reynoso et al., "Intestinal Tolerance Is Converted to Autoimmune Enteritis upon PD-1 Ligand Blockade," J Immunol (2009) 182(4):2102-2112.
Rozali et al., "Programmed death ligand 2 in cancer-induced immune suppression," Clin Dev Immunol (2012) 2012:656340.
Sadelain, M. et al., "The basic principles of chimeric antigen receptor design." Cancer Discov., Apr. 2013, vol. 3, No. 4, pp. 388-398.
Scatchard et al., "The attractions of proteins for small molecules and ions," Ann. N.Y. Acad. Sci. (1949) 51:660.
Shenoi et al., "Comparison of biomarkers for systemic juvenile idiopathic arthritis," Pediatric Research (2015) 78(5):554-559.
Sim et al., "Altered expression of costimulatory molecules in Behet's disease according to clinical activity," Br J Dermatol (2011) 164(6):1285-1291.
Song et al., "Protective effects of Fc-fused PD-L1 on two different animal models of colitis," Gut (2015) 64:260-271.
Sturmhoefel et al., "Potent Activity of Soluble B7-IgG Fusion Proteins in Therapy of Established Tumors and as Vaccine Adjuvant," Cancer Res. (1999) 59(19): 4964-4972.
Swanson et al., "CD80 vlgD-Fc proteins combine checkpoint antagonism and costimulatory signaling for elicit potent anti-tumor immunity in vitro and in vivo" American Association for Cancer Research (AACR). Chicago, IL, Apr. 14-18, 2018, Abstract 4550, 1 page.
Taylor et al., "Targeting of inducible costimulator (ICOS) expressed on alloreactive T cells down-regulates graft-versus-host disease (GVHD) and facilitates engraftment of allogeneic bone marrow (BM)", Blood. (2005) 105(8): 3372-3380.
Teshima et al., "Response: Recipient plasmacytoid dendritic cells and graft-versus-host disease", Blood. (2009) 114(6): 1280.
Uzzaman et al., "Classification of hypersensitivity reactions," Allergy Asthma Proc. (2012) 33: S96-S99.
Van Der Lugt et al., "ST2 as a marker for risk of therapy-resistant graft-versus-host disease and death," N Engl J Med. (2013) 369(6): 529-539.
Voulgaraki et al., "Multivalent recombinant proteins for probing functions of leucocyte surface proteins such as the CD200 receptor," Immunology. (2005) 115(3): 337-346.
Watkins et al., "CD28 blockade controls T cell activation to prevent graft-versus-host disease in primates", J Clin Invest. (2018) 128(9): 3991-4007.
Wei et al., "Strength of PD-1 signaling differentially affects T-cell effector functions," PNAS (2013) 110(27):E2480-E2489.
Whitlow et al., "An improved linker for single-chain Fv with reduced aggregation and enhanced proteolytic stability," Protein Eng (1993) 6(8):989-995.
Wikenheiser et al., "ICOS Co-Stimulation: Friend or Foe?," Front Immunol (2016) (7):304, 16 pgs.
Wilson et al., Analyzing biomolecular interactions, Science. (2002) 295(5562): 2103-2105.
Wolff et al., "Monoclonal Antibody Homodimers: Enhanced Antitumor Activity in Nude Mice," Cancer Res. (1993) 53(11): 2560-2565.
Yokosuka et al., "Programmed cell death 1 forms negative costimulatory microclusters that directly inhibit T cell receptor signaling by recruiting phosphatase SHP2," J Exp Med (2012) 209(6):1201-1217.
Zamani et al., "PD-1/PD-L and autoimmunity: A growing relationship," Cell Immunol (2016) 310:27-41.

(56) References Cited

OTHER PUBLICATIONS

Zapata et al., "Engineering linear F(ab')2 fragments for efficient production in *Escherichia coli* and enhanced antiproliferative activity," Protein Eng. (1995) 8(10): 1057-62.
Zeiser et al., "Acute Graft-versus-Host Disease—Biologic Process, Prevention, and Therapy", N Engl J Med. Nov. 30, 2017;377(22):2167-2179.
Zhang et al., "Crystal structure of the receptor-binding domain of human B7-2: insights into organization and signaling," Proc Natl Acad Sci U S A. (2003) 100(5):2586-91.
Zhang et al., "Immunoinhibitory checkpoint deficiency in medium and large vessel vasculitis," PNAS (2017) 114(6):E970-E979.
Zhang et al., "Preterminal host dendritic cells in irradiated mice prime CD8+ T cell-mediated acute graft-versus-host disease," J Clin Invest. (2002) 109(10): 1335-1344.
Zhang et al., "ST2 blockade reduces sST2-producing T cells while maintaining protective mST2-expressing T cells during graft-versus-host disease", Sci Transl Med. (2015) 7(308): 308ra160.
Zhong et al., "Lower expression of PD-1 and PD-L1 in peripheral blood from patients with chronic ITP," Hematology (2016) 21(9):552-557.
Zhou et al., "Endogenous programmed death ligand-1 restrains the development and onset of Sjögren's syndrome in non-obese diabetic mice," Scientific Reports. (2016) vol. 6; Article No. 39105.
Zimin et al., "A new rhesus macaque assembly and annotation for next-generation sequencing analyses," Biol Direct. Oct. 14, 2014;9(1):20.
Partial European Search Report for Application No. 18793148.0, dated Mar. 16, 2023, 3 pages.

* cited by examiner

CTLA-4 VARIANT IMMUNOMODULATORY PROTEINS AND USES THEREOF

CROSS-REFERENCED TO RELATED APPLICATIONS

This application is a National Stage application under 35 U.S.C. § 371 of International Application No. PCT/US2018/055095, filed on Oct. 9, 2018, which claims priority benefit to U.S. Provisional Application No. 62/733,615, filed on Sep. 19, 2018, U.S. Provisional Application No. 62/613,379, filed on Jan. 3, 2018, and U.S. Provisional Application No. 62/570,619, filed on Oct. 10, 2017, the contents of each of which are hereby incorporated by reference in their entirety.

INCORPORATION BY REFERENCE OF SEQUENCE LISTING

The present application is being filed along with a Sequence Listing in electronic format. The Sequence Listing is provided as a file entitled 761612002000SeqList.txt, created Mar. 31, 2020 which is 1,138,346 bytes in size. The information in the electronic format of the Sequence Listing is incorporated by reference in its entirety.

FIELD

The present disclosure relates to immunomodulatory proteins comprising variant CTLA-4 and nucleic acids encoding such proteins. The immunomodulatory proteins provide therapeutic utility for a variety of disease applications, including for treatment of autoimmune or inflammatory conditions. Compositions and methods for making and using such proteins are provided.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins that meet such needs.

SUMMARY

Provided herein are variant CTLA-4 polypeptides. In some embodiments, provided herein is a variant CTLA-4 polypeptide, containing an IgV domain or a specific binding fragment thereof, wherein the variant CTLA-4 polypeptide contains one or more amino acid modifications in an unmodified CTLA-4 polypeptide or a specific binding fragment thereof, wherein the variant CTLA-4 polypeptide specifically binds to the ectodomain of ICOSL with increased affinity compared to the unmodified CTLA-4.

In some of any of the provided embodiments, the variant CTLA-4 polypeptide contains one or more amino acid modifications in the unmodified CTLA-4 polypeptide or a specific binding fragment thereof corresponding to position(s) selected from among 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, and 122 with reference to positions set forth in SEQ ID NO:2.

In some of any of the provided embodiments, provided herein is a variant CTLA-4 polypeptide, containing an IgV domain or a specific binding fragment thereof, wherein the variant CTLA-4 polypeptide contains one or more amino acid modifications in an unmodified CTLA-4 polypeptide or a specific binding fragment thereof corresponding to position(s) selected from among 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, and 122 with reference to positions set forth in SEQ ID NO:2. In some embodiments, the amino acid modifications include amino acid substitutions, deletions or insertions.

In some of any of the provided embodiments, the unmodified CTLA-4 polypeptide is a mammalian CTLA-4 polypeptide or a specific binding fragment thereof. In some embodiments, the unmodified CTLA-4 polypeptide is a human CTLA-4 polypeptide or a specific binding fragment thereof. In some embodiments, the variant CTLA-4 polypeptide contains the extracellular domain of a human CTLA-4, wherein the one or more amino acid modifications are in one or more residues of the extracellular domain of the unmodified CTLA-4 polypeptide.

In some of any of the provided embodiments, the unmodified CTLA-4 polypeptide contains (i) the sequence of amino acids set forth in SEQ ID NO:2, (ii) a sequence of amino acids that has at least 95% sequence identity to SEQ ID NO:2; or (iii) a portion thereof containing an IgV domain or specific binding fragment of the IgV domain. In some embodiments, the unmodified CTLA-4 contains the sequence of amino acids set forth in SEQ ID NO:2.

In some of any of the provided embodiments, the specific binding fragment of the IgV domain has a length of at least 50, 60, 70, 80, 90, 100, 110 or more amino acids; or the specific binding fragment of the IgV domain includes a length that is at least 80% of the length of the IgV domain set forth as residues 39-140 of SEQ ID NO:1.

In some of any of the provided embodiments, the variant CTLA-4 contains up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.

In some of any of the provided embodiments, the variant CTLA-4 polypeptide contains a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:2 or a specific binding fragment thereof.

In some of any of the provided embodiments, the variant CTLA-4 polypeptide specifically binds to the ectodomain of ICOSL, CD80 and/or CD86 with increased affinity compared to the binding of the unmodified CTLA-4 polypeptide for the same ectodomain(s).

Provided herein are variant CTLA-4 polypeptides containing one or more amino acid modifications in the extracellular domain of a human CTLA-4 set forth in SEQ ID NO:2, wherein the variant CTLA-4 polypeptide specifically binds to the ectodomain of human ICOSL, CD80 and/or CD86 with increased affinity compared to the CTLA-4 containing the extracellular domain set forth in SEQ ID NO:2.

In some of any of the provided embodiments, the one or more amino acid modifications are selected from A6T, V10A, L12F, L12H, L12I, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, P102L, Y105F, Y105L, L106I, L106N, L106R, I108F, I108V, N110K, N110S, N110Y, Y115N, V116A, I117E, I117L, I117M, I117T, and P121S, or a conservative amino acid substitution thereof.

In some of any of the provided embodiments, the variant CTLA-4 polypeptides contain one or more amino acid modifications selected from among A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99L/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V, M56V/E59G/L63P/S72G/M87K/I93V/L98Q/M99L/Y105L/I117E, T61A/L63P/S72G/L98Q/M99L/Y105L, L63P, L63P/T69A/L98Q/M99L/Y105L/L106R/V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, S72G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, L98R/N110K, T89A/L98Q/M99L/Y105L/L106I/Y115N/E120D/C122P/D124P/S125I/D126P, N58S/L63P/T71A/S72G/L98Q/M99L/Y105L/D124I/S125P/D126T, R16G/E33M/

N58S/E59G/L63P/L98Q/Y105L/E120D/C122P/D124P/S125I/D126P, G29W/L63P/S72G/L98Q/Y105L/P121S/D126T, L12H/E33M/L98Q/Y105L, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/L98Q, T53S/M56K/N58S/L63P/M87V/Y105L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/Y105L, E33V/M99L/Y105L, E33V/L98Q/M99L, E33V/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L, M56T/L98Q/Y105L, L12F/R16H/G29W/M56T/S72G/L98Q/Y105L, G29W/M56T/S72G/L98Q/Y105L and I18T/T61R/L63P/S72G/L98Q/M99L/P102L/Y105L.

In some of any of the provided embodiments, the variant CTLA-4 polypeptide contains the sequence of amino acids set forth in any of SEQ ID NOs: 4-97, 99-104, 106-155 or 570-637 or a specific binding fragment thereof. In some embodiments, the variant CTLA-4 polypeptide contains a sequence of amino acids that exhibits at least 95% sequence identity to any of SEQ ID NOs: 4-97, 99-104, 106-155 or 570-637 or a specific binding fragment thereof, and that contains the one or more of the amino acid modifications of the respective SEQ ID NO, compared to wild-type or unmodified CTLA-4, e.g. set forth in SEQ ID NO:2.

In some of any of the provided embodiments, the variant CTLA-4 polypeptide specifically binds to the ectodomain of ICOSL with increased affinity compared to the binding of the unmodified CTLA-4 for the same ectodomain.

In some of any of the provided embodiments, the one or more amino acid modifications are at a position corresponding to position(s) selected from among 10, 12, 16, 18, 19, 26, 28, 29, 33, 35, 38, 42, 45, 47, 53, 55, 56, 58, 61, 63, 64, 65, 67, 69, 72, 76, 82, 85, 87, 89, 93, 97, 98, 99, 105, 106, 108, 110, 113, 116, 117 or 121, with reference to positions set forth in SEQ ID NO:2. In some embodiments, the one or more amino acid modifications are selected from V10A, L12F, L12I, L12P, R16H, I18F, I18N, I18T, I18V, A19V, A26T, P28L, G29W, E33M, E33V, R35K, V38I, A42V, Q45H, T47A, T53S, M55T, M56K, M56T, M56V, N58D, N58S, T61A, T61R, L63H, L63P, D64E, D64N, D64V, D65G, I67N, I67T, I67V, T69A, T69I, S72G, Q76R, Q82H, Q82R, R85G, M87K, M87T, M87V, T89A, T89S, I93L, I93V, E97Q, L98Q, M99I, M99L, Y105L, L106I, L106R, I108F, I108V, N110K, Q113H, V116A, I117L or P121S, with reference to positions set forth in SEQ ID NO:2.

In some of any of the provided embodiments, the one or more amino acid modifications are selected from V10A, L12F, L12I, R16H, I18N, I18T, I18V, A19V, A26T, G29W, E33M, E33V, R35K, V38I, A42V, Q45H, T47A, T53S, M55T, M56K, M56V, N58D, N58S, T61A, T61R, L63H, L63P, D64E, D64N, D64V, D65G, I67N, I67T, I67V, T69I, S72G, Q76R, Q82H, Q82R, R85G, M87K, M87T, M87V, T89A, T89S, I93L, I93V, E97Q, L98Q, M99I, M99L, Y105L, L106I, L106R, I108F, I108V, N110K, Q113H, I117L, and P121S, or a conservative amino acid substitution thereof.

In some of any of the provided embodiments, the one or more amino acid modifications are L63P/S72G/L98Q/M99L/Y105L/L106I/I117L, G29W/L98Q/M99L/Y105L, M55T/S72G/L98Q/M99L/Y105L, L63P/Q82H/L98Q/M99L/Y105L, I18T/L63P/S72G/L98Q/M99L/Y105L, T61A/L63P/S72G/L98Q/M99L/Y105L, V38I/L63P/S72G/L98Q/M99L/Y105L, L63P/S72G/I93L/L98Q/M99L/Y105L, L12I/M55T/M56V/I67T/M99L/L106R/I108F, I18N/A26T/L63H/T89A/L98Q/M99L/Y105L, G29W/N58S/L63P/M87T/L98Q/M99L/Y105L, G29W/N58S/L63P/D64N/L98Q/M99L/Y105L, I18T/L63P/S72G/M87K/L98Q/M99L/Y105L, L63P/M87K/M99L/L106R, L63P/M99L/Y105L/I108F, G29W/L63P/L98Q/M99L/Y105L, A26T/L63P/D65G/L98Q/M99L/Y105L, V10A/L63P/D64V/S72G/L98Q/M99L/Y105L, I18V/A26T/L63P/D64E/L98Q/Y105L/L106R/N110K, A19V/G29W/R35K/L63P/L98Q/M99L/Y105L, G29W/N58S/L63P/T69I/L98Q/M99L/Y105L, G29W/T53S/M56K/L63P/L98Q/Y105L, L12F/R16H/G29W/M56T/L98Q/Y105L, A26T/T53S/L63P/L98Q/Y105L/L106I/I117L, G29W/S72G/Q76R/L98Q/Y105L/L106I/Q113H, G29W/N58D/I67V/L98Q/M99L/Y105L, I67V/S72G/Q82H/T89A/L98Q/M99L/Y105L, S72G/R85G/L98Q/M99L/Y105L/L106I, A26T/T47A/M56K/L63P/S72G/Q82R/L98Q/M99L/Y105L, A26T/M55T/L63P/S72G/L98Q/M99L/Y105L, G29W/M87K/I93V/L98Q/M99L/Y105L, G29W/T53S/M56K/L63P/Q82H/L98Q/M99L/Y105L, L63P/L98Q/M99L/Y105L/I108V, A26T/A42V/Q45H/I67N/M87K/E97Q/M99L, E33M/L63P/S72G/L98Q/Y105L, G29W/M87K/T89S/L98Q/M99L/Y105L/I108V/I117L, I18T/T61R/L63P/S72G/L98Q/M99L/Y105L, E33M/L63P/S72G/L98Q/Y105L/I108F, G29W/T53S/M56K/N58S/L63P/M87V/L98Q/Y105L/P121S, G29W/T53S/M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/M87V/L98Q, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L, L12F/R16H/G29W/M56T/Y105L or L12F/L98Q/Y105L. In some embodiments, the amino acid substitutions are G29W/L98Q/M99L/Y105L, L63P/M99L/Y105L/I108F, I18V/A26T/L63P/D64E/L98Q/Y105L/L106R/N110K, G29W/N58D/I67V/L98Q/M99L/Y105L, I67V/S72G/Q82H/T89A/L98Q/M99L/Y105L, S72G/R85G/L98Q/M99L/Y105L/L106I, G29W/M87K/I93V/L98Q/M99L/Y105L, G29W/T53S/M56K/L63P/Q82H/L98Q/M99L/Y105L, A26T/A42V/Q45H/I67N/M87K/E97Q/M99L, G29W/M87K/T89S/L98Q/M99L/Y105L/I108V/I117L, G29W/T53S/M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L or L12F/L98Q/Y105L.

In some of any of the provided embodiments, the one or more amino acid modifications comprise one or more modifications at a position corresponding to position(s) 12, 26, 63, 98 or 105 and/or the one or more amino acid modifications containing one or modifications selected from L12P, L12F, A26T, L63P, L98Q or Y105L, with reference to positions set forth in SEQ ID NO:2.

In some of any of the provided embodiments, the variant CTLA-4 polypeptide contains one or more amino acid modifications selected from among L12P/A26T/L63P/L98Q/Y105L; A26T/L63P/S72G/L98Q/M99L/Y105L; M55T/S72G/L98Q/M99L/Y105L; L63P/Q82H/L98Q/M99L/Y105L; I18T/L63P/S72G/L98Q/M99L/Y105L; T61A/L63P/S72G/L98Q/M99L/Y105L; V38I/L63P/S72G/L98Q/M99L/Y105L; L63P/S72G/I93L/L98Q/M99L/Y105L; L12I/M55T/M56V/I67T/M99L/L106R/I108F; I18N/A26T/L63H/T89A/L98Q/M99L/Y105L; G29W/N58S/L63P/M87T/L98Q/M99L/Y105L; G29W/N58S/L63P/D64N/L98Q/M99L/Y105L; I18T/L63P/S72G/M87K/L98Q/M99L/Y105L; L63P/M87K/M99L/L106R; L63P/M99L/Y105L/I108F; G29W/L63P/L98Q/M99L/Y105L; A26T/L63P/D65G/L98Q/M99L/Y105L; V10A/L63P/D64V/S72G/L98Q/M99L/Y105L; I18V/A26T/L63P/D64E/L98Q/Y105L/L106R/N110K; A19V/G29W/R35K/L63P/L98Q/M99L/Y105L; G29W/N58S/L63P/T69I/L98Q/M99L/Y105L; L63P/T69A/L98Q/M99L/Y105L/L106R/V116A; G29W/T53S/M56K/L63P/L98Q/Y105L; G29W/L63P/S72G/L98Q/Y105L/I117L; L63P/S72G/L98Q/Y105L/L106I/I117L; L12F/R16H/G29W/M56T/L98Q/Y105L; A26T/T53S/L63P/L98Q/Y105L/L106I/I117L; G29W/S72G/Q76R/L98Q/Y105L/L106I/Q113H; G29W/N58D/I67V/L98Q/M99L/Y105L; I67V/S72G/Q82H/T89A/L98Q/M99L/Y105L; S72G/R85G/L98Q/M99L/Y105L/L106I; A26T/T47A/M56K/L63P/S72G/Q82R/L98Q/M99L/Y105L; A26T/M55T/L63P/S72G/L98Q/M99L/Y105L; G29W/M87K/I93V/L98Q/M99L/Y105L; P28L/E33V/L63P/S72G/L98Q/M99L/Y105L; G29W/T53S/M56K/L63P/Q82H/L98Q/M99L/Y105L; I18F/L63P/L98Q/M99L/Y105L/P121S; L63P/L98Q/M99L/Y105L/I108V; A26T/A42V/Q45H/I67N/M87K/E97Q/M99L; E33M/L63P/S72G/L98Q/Y105L; G29W/M87K/T89S/L98Q/M99L/Y105L/I108V/I117L; I18T/T61R/L63P/S72G/L98Q/M99L/Y105L; E33M/L63P/S72G/L98Q/Y105L/I108F; G29W/T53S/M56K/N58S/L63P/M87V/L98Q/Y105L/P121S; G29W/T53S/M56K/N58S/L63P/M87V/L98Q/Y105L; and G29W/T53S/M56K/N58S/L63P/M87V/L98Q/Y105L/I108V, with reference to positions set forth in SEQ ID NO:2.

In some of any of the provided embodiments, the variant CTLA-4 polypeptide specifically binds to the ectodomain of CD80 with increased affinity compared to the binding of the unmodified CTLA-4 for the same ectodomain. In some embodiments, the one or more amino acid modifications are at a position corresponding to position(s) selected from among 10, 12, 16, 18, 26, 29, 42, 45, 53, 56, 58, 63, 67, 72, 82, 87, 97, 98, 99, 105, 108 or 121, with reference to positions set forth in SEQ ID NO:2. In some embodiments, the one or more amino acid modifications are selected from V10A, L12F, R16H, I18T, A26T, G29W, E33V, A42V, Q45H, T53S, M55T, M56K, M56T, N58S, L63P, I67N, Q82R, M87K, M87V, E97Q, L98Q, M99L, Y105L, I108V, or a conservative amino acid substitution thereof.

In some of any of the provided embodiments, the one or more amino acid modifications are at a position corresponding to position(s) selected from among V10A, L12F, R16H, I18T, A26D, A26T, G29W, A42V, Q45H, T53S, M56K, M56T, N58S, L63P, I67N, S72G, Q82R, M87K, M87V, E97Q, L98Q, M99L, Y105L, I108V, or P121S, with reference to positions set forth in SEQ ID NO:2.

In some of any of the provided embodiments, the one or more amino acid modifications are selected from I18T/G29W/L63P/L98Q/Y105L; G29W/L63P/L98Q/M99L/Y105L; G29W/N58S/L63P/L98Q/Y105L; A26D/S72G/L98Q/M99L/Y105L; G29W/N58S/L63P/Q82R/L98Q/Y105L; L12F/R16H/G29W/M56T/L98Q/Y105L; A26T/A42V/Q45H/I67N/M87K/E97Q/M99L; G29W/T53S/M56K/N58S/L63P/M87V/L98Q/Y105L/P121S; G29W/T53S/M56K/N58S/L63P/M87V/L98Q/Y105L; G29W/T53S/M56K/N58S/L63P/M87V/L98Q/Y105L/I108V and V10A/G29W/T53S/M56K/L63P/L98Q/Y105L/P121S, with reference to positions set forth in SEQ ID NO:2.

In some of any of the provided embodiments, the one or more amino acid modifications are selected from among I18T/G29W/L63P/L98Q/Y105L, G29W/N58S/L63P/L98Q/Y105L, G29W/N58S/L63P/Q82R/L98Q/Y105L, L12F/R16H/G29W/M56T/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, V10A/G29W/T53S/M56K/L63P/L98Q/Y105L/P121S, T53S/M56K/N58S/L63P/M87V/L98Q/Y105L, I18T/A26T/M55T/M56K/L63P/L98Q/M99L/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L or M56T/L98Q/Y105L. In some embodiments, the one or more amino acid modifications are selected from among I18T/G29W/L63P/L98Q/Y105L, G29W/N58S/L63P/L98Q/Y105L, G29W/N58S/L63P/Q82R/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, L98Q/M99L/Y105L, E33V/L98Q/Y105L, T53S/M56K/N58S/L63P/L98Q/Y105L, T53S/M56K/N58S/M87V/L98Q/Y105L and E33V/L98Q/M99L.

In some of any of the provided embodiments, the variant CTLA-4 polypeptide specifically binds to the ectodomain of ICOSL and CD80 with increased affinity compared to the binding of the unmodified CTLA-4 for the same ectodomains. In some embodiments, the one or more amino acid modifications are selected from V10A, L12F, R16H, I18T, A26T, G29W, E33V, A42V, Q45H, T53S, M55T, M56K, N58S, L63P, I67N, Q82R, M87K, M87V, E97Q, L98Q, M99L, Y105L, I108V, or a conservative amino acid substitution thereof. In some embodiments, the one or more amino acid modifications are selected from I18T, A26T, G29W, E33V, Q45H, T53S, M56K, N58S, L63P, I67N, Q82R, M87K, M87V, E97Q, L98Q, M99L, Y105L, I108V.

In some of any of the provided embodiments, the variant CTLA-4 polypeptide specifically binds to the ectodomain of CD86 with increased affinity compared to the binding of the unmodified CTLA-4 for the same ectodomain.

In some of any of the provided embodiments, the one or more amino acid modifications are at a position corresponding to position(s) selected from among 10, 12, 16, 18, 20, 26, 28, 29, 30, 33, 42, 47, 53, 55, 56, 58, 59, 61, 63, 65, 67, 69, 72, 76, 82, 85, 87, 89, 93, 96, 98, 99, 102, 105, 106, 108, 113, 115, 116, 117 or 121, with reference to positions set forth in SEQ ID NO:2. In some embodiments, the one or more amino acid modifications are at a position corresponding to position(s) selected from among V10A, L12F, L12H, L12P, R16H, I18T, I18V, S20N, A26S, A26T, P28L, G29R, G29W, K30R, E33M, E33V, A42S, A42T, T47A, T53S, M55T, M56K, M56R, M56T, M56V, N58D, N58S, E59G, T61I, T61N, T61R, T61S, L63P, D65G, I67N, I67V, T69A, T69I, S72G, Q76R, Q82H, Q82R, R85G, M87K, M87V, T89A, T89M, T89S, I93V, V961, L98Q, L98R, M99L, P102L, Y105L, L106I, L106N, L106R, L106V, I108F, I108V, Q113H, Y115H, V116A, I117E, I117L, I117K, I117T, and P121S, with reference to positions set forth in SEQ ID NO:2.

In some of any of the provided embodiments, the one or more amino acid modifications are selected from L12F, L12H, L12P, R16H, I18T, I18V, S20N, A26T, G29R, G29W, E33M, E33V, A42S, A42V, T47A, T53S, M55T, M56K, M56R, M56T, M56V, N58D, N58S, T61I, T61N, T61R, T61S, L63P, D65G, I67N, I67V, T69A, T69I, S72G, Q76R, Q82H, Q82R, R85G, M87K, M87V, T89A, T89M, T89S, V961, L98Q, L98R, M99L, P102L, Y105L, L106I, L106N, L106R, L106V, I108F, I108V, Q113H, Y115H, V116A, I117L, I117T and P121S, or a conservative amino acid substitution thereof.

In some of any of the provided embodiments, the one or more amino acid modifications are selected from among L12P/A26T/L63P/L98Q/Y105L; I18T/T61R/L63P/S72G/L98Q/M99L/P102L/Y105L; L12P/A26T/L63P/S72G/T89M/L98Q/M99L/Y105L; P28L/E33V/L63P/S72G/L98R/M99L/Y105L; I18T/G29R/L63P/S72G/L98Q/M99L/Y105L; S72G/L98Q/M99L/Y105L/I117T; M56R/L63P/L98Q/M99L/Y105L; L63P/L98Q/M99L/Y105L/L106I; A26T/M55T/L63P/L98Q/M99L/Y105L; E33V/A42S/M55T/L98Q/M99L/Y105L; G29W/N58S/L63P/Q82R/L98Q/Y105L; E33M/L63P/S72G/L98Q/Y105L/I117L; A26T/I67N/S72G/L98Q/M99L/Y105L; L12F/A26T/L63P/L98Q/Y105L/L106R; S20N/A26T/L63P/L98Q/M99L/Y105L; G29W/T61I/L63P/S72G/L98Q/M99L/Y105L; G29W/N58S/L63P/T69I/L98Q/M99L/Y105L; L12P/L63P/S72G/L98Q/M99L/Y105L/L106N; L63P/T69A/L98Q/M99L/Y105L/L106R/V116A; G29W/N58S/L63P/S72G/L98Q/Y105L; G29W/L63P/D65G/S72G/L98Q/Y105L; T53S/M56V/L98Q/Y105L; L63P/S72G/L98Q/Y105L; G29W/T53S/M56K/L63P/L98Q/Y105L; I18V/G29W/L63P/S72G/L98Q/Y105L; G29W/L63P/S72G/L98Q/Y105L/L106I; G29W/L63P/I67V/S72G/L98Q/Y105L; L63P/S72G/L98Q/Y105L/L106I/I117L; L12F/R16H/G29W/M56T/L98Q/Y105L; L12P/G29W/L63P/S72G/L98Q/Y105L; G29W/N58S/L63P/S72G/M87V/L98Q/Y105L; G29W/S72G/Q76R/L98Q/Y105L/L106I/Q113H; G29W/N58S/L63P/S72G/L98Q/Y105L/L106V; A26T/L63P/L98Q/M99L/Y105L; G29W/N58D/I67V/L98Q/M99L/Y105L; I67V/S72G/Q82H/T89A/L98Q/M99L/Y105L; S72G/R85G/L98Q/M99L/Y105L/L106I; L63P/L98Q/M99L/Y105L; A26T/T47A/M56K/L63P/S72G/Q82R/L98Q/M99L/Y105L; A26T/M55T/L63P/S72G/L98Q/M99L/Y105L; L12H/I18V/A42T/M55T/N58D/L98R/Y105L/L106I/P121S; I18T/A26T/L63P/S72G/L98Q/Y105L; L12F/K30R/S72G/Q82R/L98Q/M99L/Y105L; L12P/L63P/S72G/L98Q/M99L/Y105L/L106N/I117L; G29W/M87K/I93V/L98Q/M99L/Y105L; P28L/E33V/L63P/S72G/L98Q/M99L/Y105L; E33M/L63P/S72G/L98Q/Y105L; M56V/E59G/L63P/S72G/M87K/I93V/L98Q/M99L/Y105L/I117E; G29W/M87K/T89S/L98Q/M99L/Y105L/I108V/I117L; L12P/M56V/L63P/V96I/L98Q/M99L/Y105L/Y115H; G29W/T53S/M56K/T61N/L63P/L98Q/Y105L; I18T/A26S/M55T/M56V/L63P/S72G/L98Q/M99L/Y105L/I117K; I18T/T61R/L63P/S72G/L98Q/M99L/Y105L; L12P/L63P/S72G/L98Q/M99L/Y105L; E33M/L63P/S72G/L98Q/Y105L/I108F; L12P/R16H/A26T/T61S/L63P/M87V/L98Q/M99L/Y105L/L106I/I117L G29W/T53S/M56K/N58S/L63P/M87V/L98Q/Y105L/P121S; G29W/L63P/S72G/L98Q/Y105L/P121S; and V10A/G29W/T53S/M56K/L63P/L98Q/Y105L/P121S, with reference to positions set forth in SEQ ID NO: 2.

In some of any of the provided embodiments, the one or more amino acid modifications are selected from among I18T/T61R/L63P/S72G/L98Q/M99L/P102L/Y105L, L12P/A26T/L63P/S72G/T89M/L98Q/M99L/Y105L, I18T/G29R/L63P/S72G/L98Q/M99L/Y105L, S72G/L98Q/M99L/Y105L/I117T, M56R/L63P/L98Q/M99L/Y105L, L63P/L98Q/M99L/Y105L/L106I, A26T/M55T/L63P/L98Q/M99L/Y105L, E33V/A42S/M55T/L98Q/M99L/Y105L, G29W/N58S/L63P/Q82R/L98Q/Y105L, E33M/L63P/S72G/L98Q/Y105L/I117L, A26T/I67N/S72G/L98Q/M99L/Y105L, L12F/A26T/L63P/L98Q/Y105L/L106R, S20N/A26T/L63P/L98Q/M99L/Y105L, G29W/T61I/L63P/S72G/L98Q/M99L/Y105L, G29W/N58S/L63P/T69I/L98Q/M99L/Y105L, L12P/L63P/S72G/L98Q/M99L/Y105L/L106N, L63P/T69A/L98Q/M99L/Y105L/L106R/V116A, G29W/N58S/L63P/S72G/L98Q/Y105L, G29W/L63P/D65G/S72G/L98Q/Y105L, T53S/M56V/L98Q/Y105L, L63P/S72G/L98Q/Y105L, G29W/L63P/S72G/L98Q/Y105L/L106I, L12F/R16H/G29W/M56T/L98Q/Y105L, G29W/N58S/L63P/S72G/M87V/L98Q/Y105L, G29W/S72G/Q76R/L98Q/Y105L/L106I/Q113H, G29W/N58S/L63P/S72G/L98Q/Y105L/L106V, G29W/N58D/I67V/L98Q/M99L/Y105L, I67V/S72G/Q82H/T89A/L98Q/M99L/Y105L, S72G/R85G/L98Q/M99L/Y105L/L106I, L63P/L98Q/M99L/Y105L, A26T/T47A/M56K/L63P/S72G/Q82R/L98Q/M99L/Y105L, A26T/M55T/L63P/S72G/L98Q/M99L/Y105L, L12H/I18V/A42T/M55T/N58D/L98R/Y105L/L106I/P121S, E33M/L63P/S72G/L98Q/Y105L, G29W/M87K/T89S/L98Q/M99L/Y105L/I108V/I117L, L12P/M56V/L63P/V96I/L98Q/M99L/Y105L/Y115H, G29W/T53S/M56K/T61N/L63P/L98Q/Y105L, I18T/T61R/L63P/S72G/L98Q/M99L/Y105L, L12P/L63P/S72G/L98Q/M99L/Y105L, E33M/L63P/S72G/L98Q/Y105L/I108F, L12P/R16H/A26T/T61S/L63P/M87V/L98Q/M99L/Y105L/L106I/I117L, L98Q/M99L/Y105L, T53S/M56K/N58S/M87V/L98Q/Y105L, L12F/R16H/G29W/M56T/L98Q, L12F/G29W/L98Q/Y105L or L12F/L98Q/Y105L.

In some of any of the provided embodiments, the variant CTLA-4 polypeptide specifically binds to the ectodomain of CD80 and CD86 with increased affinity compared to the binding of the unmodified CTLA-4 for the same ectodomains. In some embodiments, the one or more amino acid modifications are selected from I18T, A26T, G29W, E33V, A42V, T53S, N58S, L63P, I67N, Q82R, M87K, M87V, L98Q, M99L, Y105L, I108V.

In some of any of the provided embodiments, the variant CTLA-4 polypeptide specifically binds to the ectodomain of ICOSL and CD86 with increased affinity compared to the binding of the unmodified CTLA-4 for the same ectodomains.

In some of any of the provided embodiments, the one or more amino acid modifications are selected from L12F, R16H, I18T, I18V, A26T, G29W, E33M, E33V, A42V, T47A, T53S, M55T, M56K, M56V, N58D, N58S, T61R, L63P, D65G, I67N, I67V, T69I, S72G, Q76R, Q82H, Q82R, R85G, M87K, M87V, T89A, T89S, L98Q, M99L, Y105L, L106I, L106R, I108F, I108V, Q113H, I117L, and P121S, or a conservative amino acid substitution thereof.

In some of any of the provided embodiments, the one or more amino acid modifications are selected from L12F, R16H, I18T, I18V, A26T, G29W, E33V, A42V, T47A, T53S, M55T, M56K, N58D, N58S, L63P, I67N, I67V, S72G, Q82H, Q82R, R85G, M87K, M87V, T89A, T89S, L98Q, M99L, Y105L, L106I, L106R, I108F, I108V, and I117L.

In some of any of the provided embodiments, the variant CTLA-4 polypeptide specifically binds to the ectodomain of ICOSL, CD80, and CD86 with increased affinity compared to the binding of the unmodified CTLA-4 for the same ectodomains.

In some of any of the provided embodiments, the one or more amino acid modifications are selected from L12F, R16H, I18T, A26T, G29W, E33V, A42V, T53S, M55T, M56K, N58S, L63P, I67N, Q82R, M87K, M87V, L98Q, M99L, Y105L or I108V. In some embodiments, the one or more amino acid modifications are selected from A26T, G29W, T53S, M56K, N58S, L63P, L98Q, M99L or Y105L. In some embodiments, the one or more amino acid modifications are selected from, G29W, L63P, L98Q, M99L or Y105L. In some embodiments, the one or more amino acid modifications comprise modifications selected from G29W/L63P, G29W/L98Q, G29W/M99L, G29W/Y105L, L63P/L98Q, L63P/M99L, L63P/Y105L, L98Q/M99L, L98Q/Y105L or M99L/Y105L. In some embodiments, the amino acid modifications are G29W/L98Q/Y105L. In some embodiments, the amino acid modifications are G29W/N58S/L63P/Q82R/L98Q/Y105L. In some embodiments, the amino acid modifications are L12P/G29W/L63P/S72G/L98Q/Y105L.

In some of any of the provided embodiments, the variant CTLA-4 polypeptide specifically binds to the ectodomain of ICOSL with increased affinity and specifically binds to the ectodomain of one or more of the other of CD80 or CD86 with decreased affinity compared to the binding of the unmodified CTLA-4 for the same ectodomains.

In some of any of the provided embodiments, the increase in binding affinity for the one or more ectodomain is, independently, more than 1.2-fold, 1.5-fold, 2-fold, 3-fold, 4-fold, 5-fold, 6-fold, 7-fold, 8-fold, 9-fold, 10-fold, 20-fold, 30-fold 40-fold, 50-fold, 100-fold or more.

In some of any of the provided embodiments, the decrease in binding affinity for the one or more ectodomain is, independently, more than 1.2-fold, 1.5-fold, 2-fold, 3-fold, 4-fold, 5-fold, 6-fold, 7-fold, 8-fold, 9-fold, 10-fold, 20-fold, 30-fold 40-fold, 50-fold, 100-fold or more.

In some of any of the provided embodiments, the variant CTLA-4 polypeptide contains the IgV domain or a specific binding fragment thereof. In some embodiments, the IgV domain or specific binding fragment thereof is the only CTLA-4 portion of the variant CTLA-4 polypeptide. In some embodiments, the variant CTLA-4 polypeptide contains the sequence of amino acids set forth in any of SEQ ID NOs: 156-285, 603-635 or 637 or a specific binding fragment thereof. In some embodiments, the variant CTLA-4 polypeptide contains a sequence of amino acids that exhibits at least 95% sequence identity to any of SEQ ID NOS: 156-285, 603-635 or 637 or a specific binding fragment thereof and that contains the one or more of the amino acid modifications of the respective SEQ ID NO compared to wild-type or unmodified CTLA-4, e.g. set forth in SEQ ID NO: 156-285, 603-635 or 637. In some embodiments, the variant CTLA-4 polypeptides containing the sequence of amino acids of the extracellular domain set forth in any of SEQ ID NOS: 4-97, 99-104, 106-155, 569-602 or 636, or a specific binding fragment thereof, or a sequence of amino acids that exhibits at least 95% sequence identity to any of SEQ ID NOS: 4-97, 99-104, 106-155, 569-602 or 63, and that contains the one or more of the amino acid modifications of the respective SEQ ID NO set forth in any of SEQ ID NOS: 4-97, 99-104, 106-155, 569-602 or 636.

In some of any of the provided embodiments, the ICOSL is a human ICOSL. In some embodiments, the CD80 is a human CD80. In some embodiments, the CD86 is a human CD86.

In some embodiments, the variant CTLA-4 polypeptide is a soluble protein. In some embodiments, the variant CTLA-4 polypeptide lacks the CTLA-4 transmembrane domain and intracellular signaling domain; and/or the variant CTLA-4 polypeptide is not capable of being expressed on the surface of a cell.

In some of any of the provided embodiments, the variant CTLA-4 polypeptide is linked to a multimerization domain. In some embodiments, the multimerization domain is an Fc domain or a variant thereof with reduced effector function. In some embodiments, the variant CTLA-4 polypeptide is linked to an Fc domain or a variant thereof with reduced effector function. In some embodiments, the Fc domain is mammalian, optionally human; or the variant Fc domain contains one or more amino acid modifications compared to an unmodified Fc domain that is mammalian, optionally human. In some embodiments, the Fc domain or variant thereof contains the sequence of amino acids set forth in any of SEQ ID NOs:438-442 or a sequence of amino acids that exhibits at least 85% sequence identity to any of SEQ ID NOs:438-442. In some embodiments, the Fc domain contains one or more amino acid modifications selected from among E233P, L234A, L234V, L235A, L235E, G236del, G237A, S267K, N297G, V302C and K447del, each by EU numbering. In some embodiments, the Fc domain comprises the amino acid modifications L234A/L235E/G237A. In some embodiments, the Fc domain contains the amino acid modification C220S by EU numbering. In some embodiments, the variant CTLA-4 polypeptide is linked to the multimerization domain or Fc indirectly via a linker, optionally a G4S ($Gly_4Ser$) linker.

In some of any of the provided embodiments, the variant CTLA-4 polypeptide, linked to an Fc domain, contains the sequence of amino acids set forth in any of SEQ ID NOs: 286-379, 381-386, or 388-437 or a sequence of amino acids that exhibits at least 85% sequence identity to any of SEQ ID NOs: 286-379, 381-386, or 388-437.

In some of any of the provided embodiments, the variant CTLA-4 polypeptide is a transmembrane immunomodulatory protein further containing a transmembrane domain, optionally wherein the transmembrane domain is linked, directly or indirectly, to the extracellular domain (ECD) or specific binding fragment thereof of the variant CTLA-4 polypeptide. In some embodiments, the transmembrane domain contains the sequence of amino acids set forth as residues 162-182 of SEQ ID NO:1 or a functional variant thereof that exhibits at least 85% sequence identity to residues 162-182 of SEQ ID NO:1.

In some of any of the provided embodiments, the variant CTLA-4 polypeptide further contains a cytoplasmic domain, optionally wherein the cytoplasmic domain is linked, directly or indirectly, to the transmembrane domain. In some embodiments, the cytoplasmic domain is or contains a native CTLA-4 cytoplasmic domain, an intracellular signaling domain, and/or contains an immunoreceptor tyrosine-based inhibition motif (ITIM) signaling motif. In some embodiments, the cytoplasmic domain contains the sequence of amino acids set forth as residues 183-223 of SEQ ID NO:1 or a functional variant thereof that exhibits at least 85% sequence identity to residues 183-223 of SEQ ID NO:1. In some embodiments, the cytoplasmic domain contains an immunoreceptor tyrosine-based activation motif (ITAM) signaling motif and/or contains an intracellular signaling domain of CD3 zeta.

In some of any of provided embodiments, the variant CTLA-4 polypeptide does not contain a cytoplasmic signaling domain and/or is not capable of mediating or modulating an intracellular signal when expressed on a cell.

In some of any of the provided embodiments, the variant CTLA-4 polypeptide decreases IFN-gamma (interferon-gamma) expression relative to the unmodified CTLA-4 polypeptide in an in vitro primary T-cell assay. In some embodiments, the variant CTLA-4 polypeptide is deglycosylated.

In some of any of the provided embodiments, provided herein is an immunomodulatory polypeptide containing any of the provided variant CTLA-4 linked, directly or indirectly via a linker, to a second polypeptide containing an immunoglobulin superfamily (IgSF) domain of an IgSF member. In some embodiments, the IgSF domain is an affinity-modified IgSF domain, said affinity-modified IgSF domain containing one or more amino acid modifications compared to the unmodified or wild-type IgSF domain of the IgSF family member. In some cases, the affinity-modified IgSF domain exhibits altered binding to one or more of its cognate binding partner(s) compared to the binding of the unmodified or wild-type IgSF domain of the IgSF family member to the same one or more cognate binding partner(s). In some embodiments, the IgSF domain exhibits increased binding to one or more of its cognate binding partner(s) compared to the binding of the unmodified or wild-type IgSF domain to the same one or more cognate binding partner(s).

In some of any of the provided embodiments, the variant CTLA-4 is a first variant CTLA-4 polypeptide and the IgSF domain of the second polypeptide is an IgSF domain from a second variant CTLA-4 polypeptide, wherein the first and second variant CTLA-4 are the same or different. In some aspects, the immunomodulatory protein further contains a third polypeptide containing an IgSF domain of an IgSF family member or an affinity-modified IgSF domain thereof, said affinity-modified IgSF domain containing one or more amino acid modifications compared to the unmodified or wild-type IgSF domain of the IgSF family member. In some examples, the third polypeptide is the same as the first and/or second polypeptide; or the third polypeptide is different from the first and/or second polypeptide.

In some of any of the provided embodiments, the IgSF domain or affinity-modified IgSF domain thereof, optionally of the second or third polypeptide, is or includes an IgV domain. In some cases, the variant CTLA-4 polypeptide is or contains an IgV domain.

In some of any of the provided embodiments, the immunomodulatory protein further contains a multimerization domain linked to at least one of the variant CTLA-4 polypeptide, or the second polypeptide. In some aspects, the immunomodulatory protein further includes a multimerization domain linked to at least one of the variant CTLA-4 polypeptide, the second polypeptide and/or the third polypeptide. In some cases, the multimerization domain is an Fc domain or a variant thereof with reduced effector function.

In some of any of the provided embodiments, the multimerization domain promotes heterodimer formation. Provided herein is an immunomodulatory protein containing any of the provided immunomodulatory proteins, wherein the multimerization domain is a first multimerization domain and interacts with a second multimerization domain to form a multimer containing the immunomodulatory protein. In some cases, the immunomodulatory protein is a first immunomodulatory protein and a second immunomodulatory protein is linked directly or indirectly via a linker to the second multimerization domain, wherein the multimer contains the first and second immunomodulatory protein. In some embodiments, the second immunomodulatory protein is an immunomodulatory protein provided herein, wherein the multimerization domain is the second multimerization domain.

In some of any of the provided embodiments, provided here in is an immunomodulatory protein containing a first variant CTLA-4 polypeptide, in which the multimerization domain is a first multimerization domain, and a second variant CTLA-4 polypeptide, in which the multimerization domain is a second multimerization domain, wherein the first and second multimerization domains interact to form a multimer containing the first and second variant CTLA-4 polypeptides. In some embodiments, the multimer is a dimer. In some embodiments, the immunomodulatory protein is a homodimer. In some embodiments, the immunomodulatory protein is a heterodimer. In some embodiments, the first and/or second multimerization domain is an Fc domain, or a variant thereof, with reduced effector function. In some embodiments, the first and second multimerization domains are the same or different.

In some of any of the provided embodiments, provided herein is a conjugate, containing a variant CTLA-4, or an immunomodulatory protein, linked to a moiety. In some embodiments, the moiety is a targeting moiety that specifically binds to a molecule on the surface of a cell. In some embodiments, the targeting moiety specifically binds to a molecule on the surface of an immune cell. In some embodiments, the immune cell is an antigen presenting cell or a lymphocyte. In some embodiments, the targeting moiety localizes to a cell or tissue in an inflammatory environment. In some embodiments, the moiety is a protein, a peptide, nucleic acid, small molecule or nanoparticle. In some embodiments, the moiety is an antibody or antigen-binding fragment. In some embodiments, the conjugate is divalent, tetravalent, hexavalent or octavalent.

In some of any of the provided embodiments, provided herein are nucleic acid molecule(s), encoding a variant CTLA-4 polypeptide, provided herein, or an immunomodulatory protein provided herein. In some embodiments, the nucleic acid molecule is a synthetic nucleic acid. In some embodiments, the nucleic acid molecule is a cDNA.

In some of any of the provided embodiments, provided herein is a vector, containing any of the nucleic acid molecules provided herein. In some embodiments, the vector is an expression vector. In some embodiments, the vector is a mammalian expression vector or a viral vector.

In some of any of the provided embodiments, provided herein is a cell, containing a vector provided herein. In some embodiments, the cell is a mammalian cell. In some embodiments, the cell is a human cell.

In some of any of the provided embodiments, provided herein is a method of producing a variant CTLA-4 polypeptide or an immunomodulatory protein that includes introducing a nucleic acid molecule or vector provided herein into a host cell under conditions to express the protein in the cell. In some embodiments, the method further includes isolating or purifying the variant CTLA-4 polypeptide or immunomodulatory protein from the cell.

In some of any of the provided embodiments, provided herein is a method of engineering a cell expressing a variant CTLA-4 polypeptide that includes introducing a nucleic acid molecule encoding a variant CTLA-4 polypeptide or immunomodulatory protein provided herein into a host cell under conditions in which the polypeptide is expressed in the cell.

In some of any of the provided embodiments, provided herein is an engineered cell, expressing a variant CTLA-4 polypeptide, an immunomodulatory protein, a nucleic acid molecule, or a vector provided herein. In some embodiments, the cell is an immune cell. In some embodiments, the immune cell is a lymphocyte. In some embodiments, the lymphocyte is a T cell. In some embodiments, the T cell is a CD4+ and/or CD8+ T cell. In some embodiments, the T cell is a regulatory T cell (Treg). In some embodiments, the engineered cell is a primary cell. In some embodiments, the engineered cell is a mammalian cell. In some embodiments, the engineered cell is a human cell.

In some of any of the provided embodiments, the CTLA-4 polypeptide is expressed on the surface of the cell, provided herein, via a transmembrane domain. In some of such embodiments, the CTLA-4 polypeptide contains a cytoplasmic domain, optionally wherein the cytoplasmic domain is linked, directly or indirectly, to the transmembrane domain. In some embodiments, the cytoplasmic domain is or contains a native CTLA-4 cytoplasmic domain, an intracellular signaling domain, and/or an ITIM signaling motif. In some embodiments, the cytoplasmic domain contains the sequence of amino acids set forth as residues 183-223 of SEQ ID NO:1 or a functional variant thereof that exhibits at least 85% sequence identity to residues 183-223 of SEQ ID NO:1. In some embodiments, the cytoplasmic domain contains an ITAM signaling motif and/or is or contains an intracellular signaling domain of CD3 zeta. In some embodiments, the CTLA-4 polypeptide does not contain a cytoplasmic signaling domain and/or is not capable of mediating or modulating an intracellular signal when expressed on a cell.

In some of any of the provided embodiments, the engineered cell further contains a chimeric antigen receptor (CAR). In some embodiments, the engineered cell further contains an engineered T-cell receptor (TCR).

In some of any of the provided embodiments, provided herein is an infectious agent, containing a nucleic acid molecule encoding a variant CTLA-4 polypeptide provided herein or an immunomodulatory protein provided herein. In some embodiments, the infectious agent is a bacterium or a virus.

In some of any of the provided embodiments, provided herein is a pharmaceutical composition, containing a variant CTLA-4 polypeptide provided herein, an immunomodulatory protein provided herein, a conjugate provided herein, an engineered cell provided herein or an infectious agent provided herein. In some embodiments, the pharmaceutical composition includes a pharmaceutically acceptable excipient. In some embodiments, the pharmaceutical composition is sterile.

In some of any of the provided embodiments, provided herein is an article of manufacture containing a pharmaceutical composition provided herein in a vial or container. In some embodiments, the vial or container is sealed.

In some of any of the provided embodiments, provided herein is a kit containing a pharmaceutical composition provided herein, and instructions for use. In some embodiments, provided herein is a kit that contains an article of manufacture provided herein, and instructions for use.

In some of any of the provided embodiments, provided herein is a method of modulating an immune response in a subject that includes administering a pharmaceutical composition provided herein to the subject. In some embodiments, provided herein is a method of modulating an immune response in a subject that includes administering the engineered cells provided herein. In some of such embodiments, the engineered cells are autologous to the subject. In some embodiments, the engineered cells are allogenic to the subject. In some embodiments, modulating the immune response treats a disease or condition in the subject.

In some of any of the provided embodiments, the immune response is decreased. In some embodiments of the provided method, a variant polypeptide provided herein, the immunomodulatory protein provided herein, or an engineered cell provided herein with a surface-expressed variant CTLA-4 containing a inhibitory (e.g. ITIM-containing) cytoplasmic signaling domain, is administered to the subject. In some embodiments, the disease or condition is an inflammatory or autoimmune disease or condition, or is a disease or condition associated with an overactive immune response. In some embodiments, the disease or condition is an antineutrophil cytoplasmic antibodies (ANCA)-associated vasculitis, a vasculitis, an autoimmune skin disease, transplantation, a Rheumatic disease, a thyroiditis, an inflammatory gastrointestinal disease, an inflammatory eye disease, an inflammatory neurological disease, an inflammatory pulmonary disease, an inflammatory endocrine disease, an autoimmune hematological disease, an autoimmune demyelinating disease, or an autoimmune disease involving a systemic autoimmune disorder. In some embodiments, the disease or condition is selected from among inflammatory bowel disease, transplant, Crohn's disease, ulcerative colitis, asthma, autoimmune asthma, rheumatoid arthritis, psoriasis, lupus erythematosus, celiac disease, type I diabetes mellitus, Guillain-Barre syndrome, Chronic inflammatory demyelinating polyneuropathy, Graves' disease, Hashimoto's thyroiditis, DeQuervains thyroiditis, myasthenia gravis, vasculitis, autoimmune hemolytic anemia, autoimmune atrophic gastritis of pernicious anemia, autoimmune encephalomyelitis, autoimmune orchitis, Goodpasture's disease, autoimmune thrombocytopenia, sympathetic opthalmia, primary biliary cirrhosis, chronic aggressive hepatitis, membranous glomerulopathy, primary idiopathic myxedema, scleroderma, chronic hepatitis, Addison's disease, hypogonadism, pernicious anemia, vitiligo, alopecia areata, autoimmune enteropathy syndrome, idiopathic thrombocytic purpura, acquired splenic atrophy, idiopathic diabetes insipidus, infertility due to antispermatazoan antibodies, sensoneural hearing loss, Sjogren's syndrome, polymyositis, multiple sclerosis, transverse myelitis, ataxic sclerosis, pemphigus, progressive systemic sclerosis, dermatomyositis, polyarteritis nodosa, hemolytic anemia, glomerular nephritis, and idiopathic facial paralysis.

In some of any of the provided embodiments of the provided method, the immune response is increased. In some embodiments of the provided method, an engineered cell provided herein, such as one expressing a surface-expressed variant CTLA-4 lacking a cytoplasmic signaling domain or a surface-expressed variant CTLA-4 containing an activating (e.g. ITAM-containing) cytoplasmic signaling domain, is administered to the subject. In some embodiments, the provided method treats a disease or condition that is a tumor or cancer. In some of such embodiments, the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

BRIEF DESCRIPTION OF THE DRAWINGS

As shown in FIG. 3A, in some cases, T cell activation is driven by CD28/TCR signal transduction induced by engagement with CD80 (B7-1) and CD86 (B7-2) costimulatory molecules expressed on an antigen-presenting cell (APC). T cell-expressed CTLA-4, such as CTLA-4 expressed on activated T cells or T regulatory cells, is constantly recycled between intracellular compartments and the cell surface, through cellular internalization. CTLA-4 also can bind the CD80 (B7-1) and CD86 (B7-2) costimulatory molecules (and, in some cases ICOSL). As shown in FIG. 3B, in some cases, binding of T cell-expressed CTLA-4 to its ligands, such as B7-1 and B7-2, allows the T cell to remove the cognate ligands from the surface of the APC in a process termed transendocytosis. Functionally, this allows CTLA-4 to "strip" the ligands off the APC, thereby preventing the CD28 costimulatory ligands from subsequently activating additional T cells and, thus, limiting T cell activation.

FIG. 5A shows various configurations in which one or more variant IgSF domain(s) (vIgD) is/are linked, directly or indirectly, to the amino terminus and/or carboxyl terminus of the light chain of an antibody. FIG. 5B shows various configurations in which one or more variant IgSF domain(s) is/are linked, directly or indirectly, to the amino terminus and/or carboxyl terminus of the heavy chain of an antibody. FIG. 5C depicts the resulting V-Mab configurations when a light chain as depicted in FIG. 5A and a heavy chain as depicted in FIG. 5B are co-expressed in a cell.

DETAILED DESCRIPTION

Figure 1:
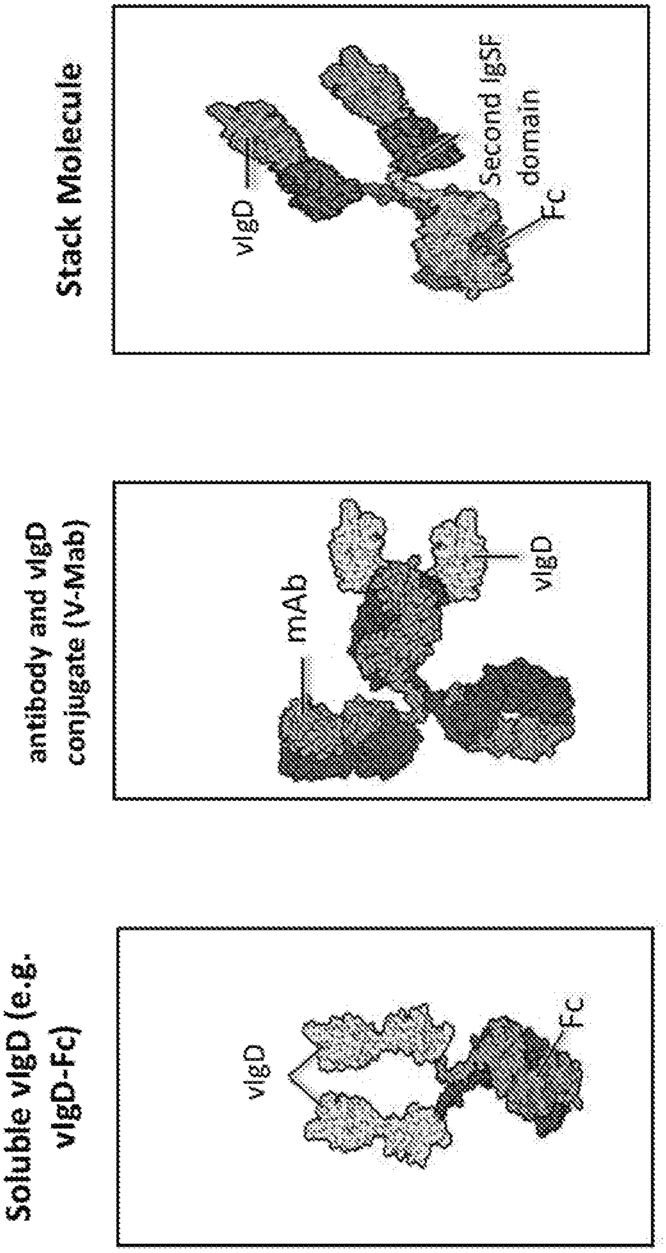
FIG. 1 depicts various soluble or non-cell expressed formats of the provided variant IgSF domain molecules, such as variant CTLA-4 polypeptides, including: (1) a variant IgSF domain (vIgD) fused to an Fc chain; (2) a variant IgSF domain (vIgD) linked to an antibody (V-mAb). The vIgD can include the ECD containing an IgV domain or the V-domain (IgV) of the CTLA-4 IgSF superfamily member; or (3) a stack molecule containing a first variant IgSF domain (first vIgD) and a second IgSF domain, such as a second variant IgSF domain (second vIgD).

Provided herein are immunomodulatory proteins that are or comprise variants or mutants of cytotoxic T-lymphocyte-associated protein 4 (CTLA-4; also known as cluster of differentiation 152 or CD152) or specific binding fragments thereof that exhibit activity to bind to at least one target binding partner. In some embodiments, the variant CTLA-4 polypeptides contain one or more amino acid modifications (e.g., amino acid substitutions, deletions or additions) compared to an unmodified or wild-type CTLA-4 polypeptide. In some embodiments, the one or more amino acid modifications (e.g., substitutions) are in the ECD of an unmodified or wild-type CTLA-4 polypeptide. In some embodiments, the one or more amino acid modifications (e.g., substitutions) are in an IgSF domain (e.g., IgV) of an unmodified or wild-type CTLA-4 polypeptide. In some embodiments, the variant CTLA-4 polypeptide and immunomodulatory proteins exhibits altered, such as increased, binding activity or affinity for Inducible T-cell COStimulator Ligand (ICOSL; also known as B7-H2, CD275, and GL50). In some embodiments, the variant CTLA-4 polypeptide and immunomodulatory proteins exhibits increased binding activity or affinity for ICOSL, CD80 (also called B7-1), and/or CD86 (also called B7-2).

In some embodiments, the variant CTLA-4 polypeptides are immunomodulatory proteins that are soluble. Such molecules include CTLA-4 polypeptides that do not contain a transmembrane domain and/or are not membrane-anchored to a cell or are not capable of being expressed on the surface of a cell. In some embodiments, the variant CTLA-4 proteins can be provided as a transmembrane immunomodulatory protein capable of being expressed on the surface of cells or as a secretable immunomodulatory protein capable of being secreted from a cell. In some embodiments, also provided herein are one or more other immunomodulatory proteins that are conjugates or fusions containing a variant CTLA-4 polypeptide provided herein and one or more other moiety or polypeptide.

In some embodiments, the variant CTLA-4 polypeptides and immunomodulatory proteins modulate an immunological immune response, such an increase or decrease of an immune response. In some embodiments, the variant CTLA-4 polypeptides and immunomodulatory proteins provided herein can be used for the treatment of diseases or conditions that are associated with a dysregulated immune response, such as autoimmune symptoms or an autoimmune disease, or, in some cases, oncology indications.

In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory to TCR engagement and is necessary for T cell proliferation, differentiation and/or survival, including, in some cases, to avoid T cell apoptosis or anergy. In some embodiments, under normal physiological conditions, the T cell-mediated immune response is initiated by antigen recognition by the T cell receptor (TCR) and is regulated by a balance of co-stimulatory (e.g., T cell activating) and co-inhibitory signals (e.g., immune checkpoint proteins). The immune system relies on immune checkpoints to prevent autoimmunity (i.e., self-tolerance) and to protect tissues from excessive damage during an immune response, for example during an attack by a pathogenic infection. In some cases, however, the immune system can become dysregulated and an abnormal immune response can be mounted against a normal body part or tissue, resulting in an autoimmune disease or condition or autoimmune symptoms. In other cases an unwanted immune response can be mounted a foreign tissue, such as a transplant, resulting in transplant rejection.

Figure 2:
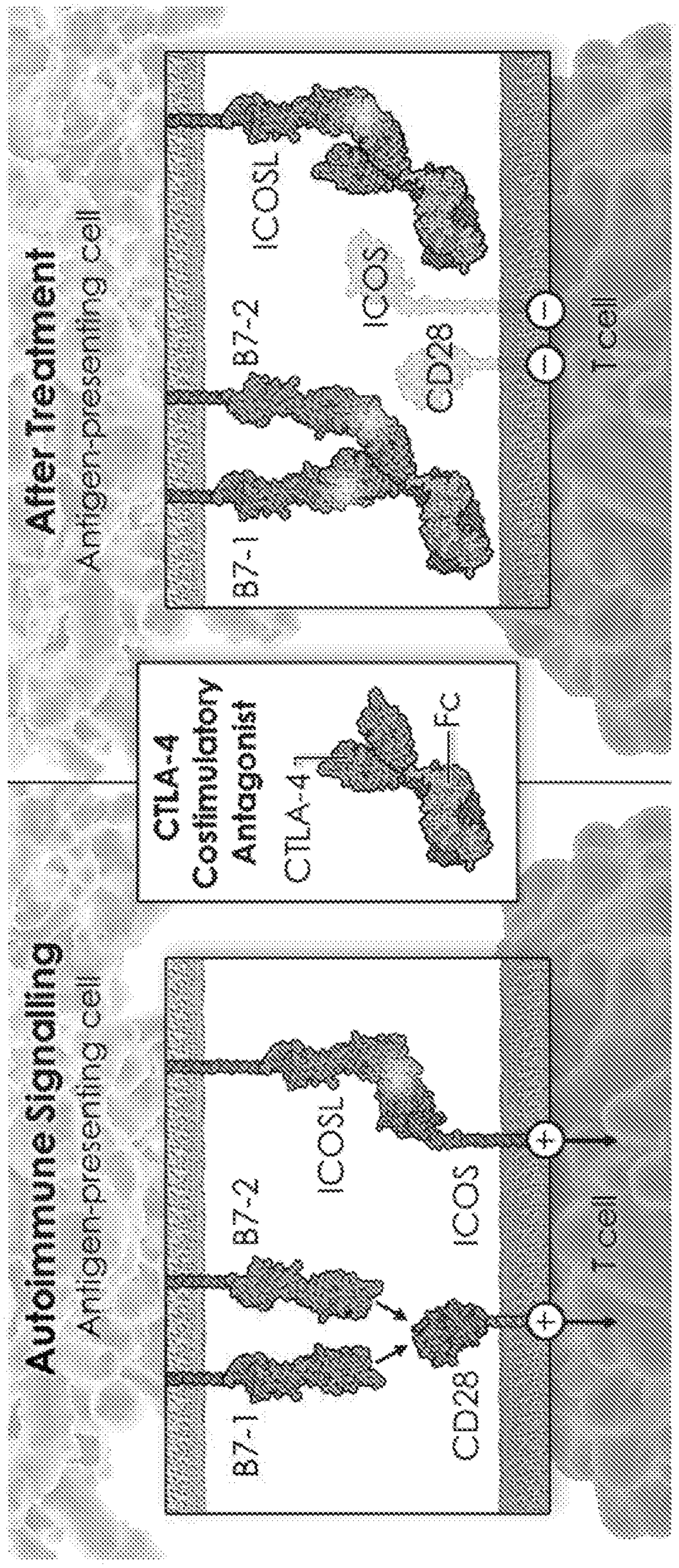
FIG. 2 exemplifies the immunomodulatory activity of an exemplary soluble CTLA-4 polypeptide. In the exemplary schematic, T cell activation results from signaling through T cell receptor (TCR) and CD28 and/or ICOS costimulatory receptors. Signaling, and T cell activation, is induced by an antigen presenting cell (APC) expressing MHC and costimulatory ligands CD80 (B7-1), CD86 (B7-2) and/or ICOSL (see left of FIG. 2). As shown, a provided variant CTLA-4 polypeptide, as exemplified in the schematic by a variant CTLA-4 IgSF domain (vIgD) fused to an Fc (CTLA-4 vIgD-Fc; see middle of FIG. 2), interacts with one or more binding partners ICOSL, CD80 (B7-1) and/or CD86 (B7-2) to block binding of T cell CD28 and ICOS activating receptors to their costimulatory ligands, thereby suppressing T cell activation, proliferation, and effector function (see right of FIG. 2).
Figure 3A:
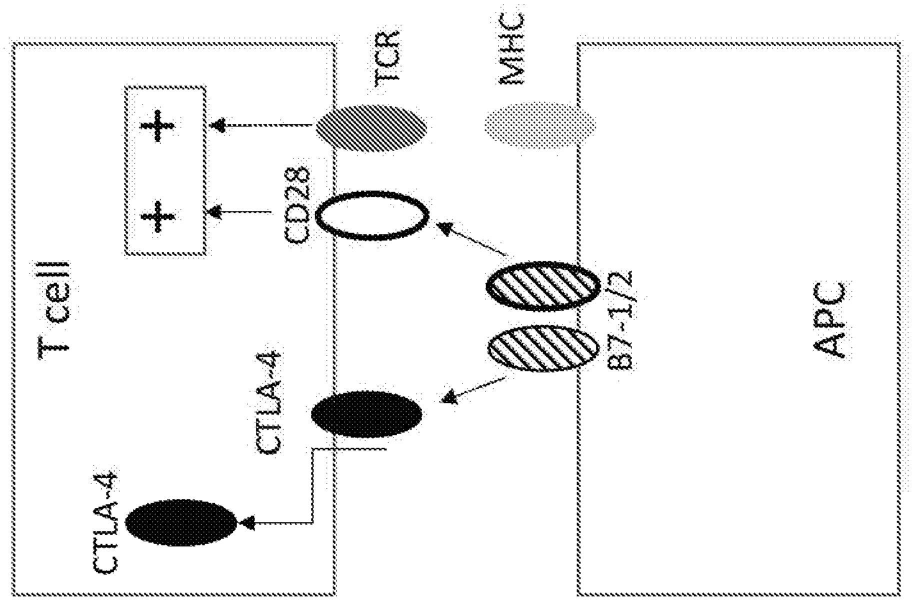
FIG. 3A and FIG. 3B depict an embodiment of expression of CTLA-4, such as a variant CTLA-4, as a transmembrane immunomodulatory protein (TIP) on the surface of a T cell.
Figure 3B:
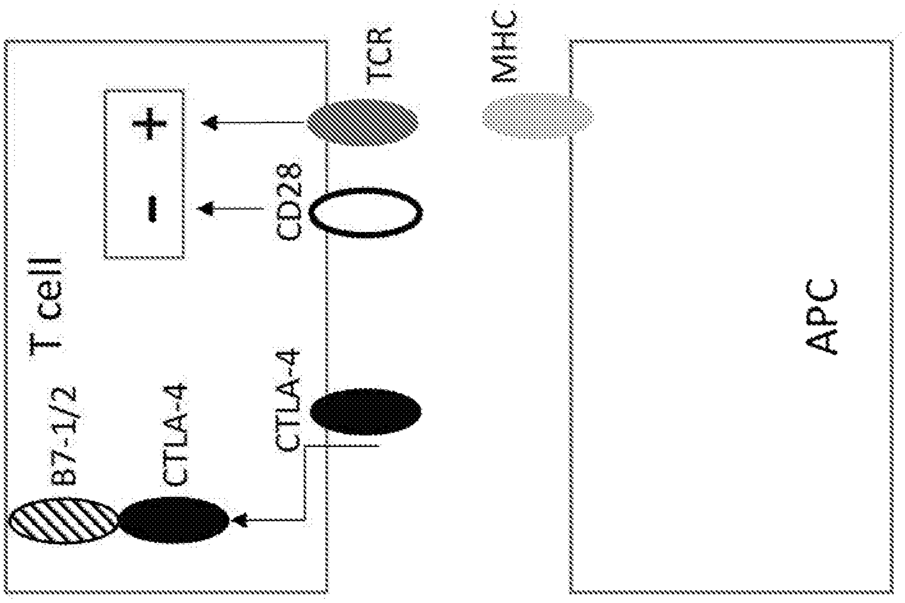
Figure 4:
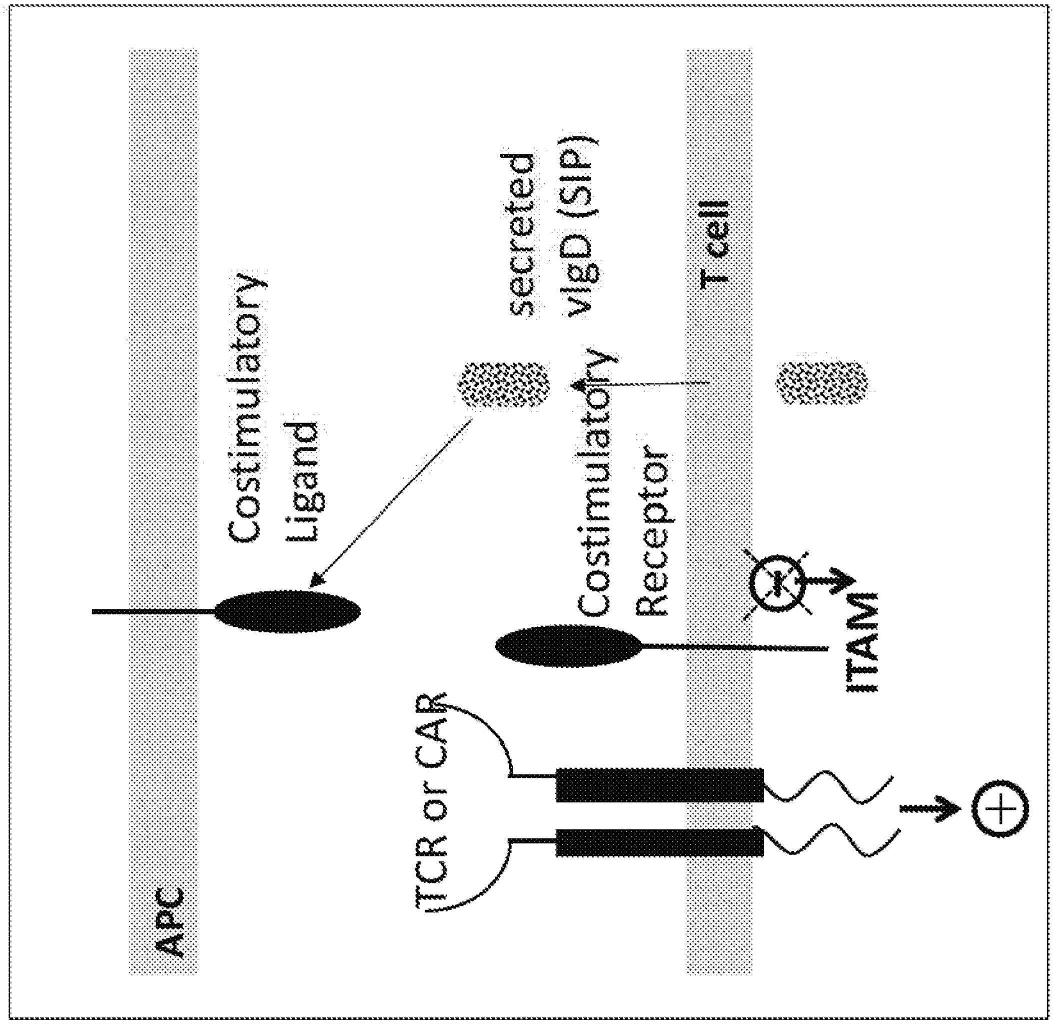
FIG. 4 depicts a secreted immunomodulatory protein (SIP) in which a variant IgSF domain (vIgD), is secreted from a cell, such as a first T cell, e.g., CAR (chimeric antigen receptor) T cell. In an exemplary embodiment, the SIP is a variant CTLA-4 polypeptide and the binding partner is a costimulatory ligand (e.g., CD80, CD86 and/or ICOSL), which can be expressed by an antigen presenting cell. Upon binding of the SIP with its binding partner, the SIP blocks the binding of the costimulatory ligand to a costimulatory receptor (e.g., CD28), thereby blocking an activating signal via the costimulatory receptor and attenuating T cell or effector T cell activation.

CTLA-4 is an inhibitory IgSF receptor that inhibits T cell responses through modulation of TCR/CD28 signaling. The costimulatory receptor, CD28, binds costimulatory ligands CD80 (also called B7-1) and CD86 (also called B7-2), and promotes activation of naïve T cells in the presence of a TCR signal. CTLA-4, a co-inhibitory receptor, competes with CD28 for binding of CD80 and CD86 to induce negative regulation of T cell activation (FIG. 2). When CTLA-4 binds CD80 and/or CD86, and prevents CD28 from binding its cognate ligands, T cells do not effectively transmit the activating signaling cascade, and T cell activation and effector function can be eliminated or attenuated. CTLA-4 also exerts inhibitory effects by capture and transendocytosis of costimulatory ligands CD80 and CD86 from opposing cells, such as APCs, thereby making these costimulatory ligands unavailable for binding the CD28 co-stimulatory receptor (FIG. 3). Engagement of the T cell receptor (TCR) enhances CTLA-4 acquisition of costimulatory ligands (Hou et al. (2015) *J. Immunol.,* 194(5):2148-59; Soskic et al. (2014) *Adv. Immunol.,* 124:95-136; Qureshi et al. (2011), *Science,* 332(6029): 600-603).

CTLA-4 has been exploited as a therapeutic drug for treating autoimmune disease by attenuating T cell activation through modulation of CD80 and/or CD86 interactions. Specifically, abatacept and belatacept are FDA-approved therapeutics for use in rheumatoid arthritis and transplant setting, respectively. Abatacept is wild-type CTLA-4 IgSF domain fused to an Fc portion of an antibody. Belatacept is a modified variant of CTLA-4 IgSF domain, containing a substitution of tyrosine for the alanine at position 31 and a glutamic acid for the leucine at position 106 (A31Y/L106E), corresponding to positions 31 and 106 of the wild-type reference CTLA-4 ECD sequence set forth in SEQ ID NO:2, to confer increased affinity toward CD80 and CD86 ligands (Kremer et al., *N Engl J Med.* 2003; 349(20):1907-1915; Larsen et al., *Am J Transplant.* 2005; 5(3):443-453).

In some aspects, ICOSL (also called B7-H2) has been reported to be a binding partner of CTLA-4 (Yao et al. (2011) *Immunity,* 34(5):729-740). ICOSL is a ligand for the co-stimulatory receptor, ICOS (FIG. 2). CD28 and CTLA-4 also can bind ICOSL, but with less affinity than ICOS. CD80, CD86, and ICOSL are normally expressed on the surface of APCs (e.g., dendritic cells). ICOSL, CD80, and/or CD86 can also be expressed on T cells, including CD4+ and CD8+ T cells. Binding of CD80, CD86 and/or ICOSL to co-stimulatory receptors, CD28 and/or ICOS, enhances immune responses, which can involve T cell activation, T cell proliferation, cytokine production, among other activities. For example, ICOSL binding to ICOS is involved in T helper cell and B cell differentiation.

Full-length CTLA-4 polypeptide contains a signaling sequence, an extracellular domain (ECD), a transmembrane region, and a cytoplasmic domain. The cytoplasmic domain contains an intracellular signaling domain. An exemplary human CTLA-4 sequence is set forth in SEQ ID NO: 1. After removal of the signal sequence, the ECD contains amino acids corresponding to amino acids 36-161 of SEQ ID NO:1. An exemplary human CTLA-4 ECD amino acid sequence is set forth in SEQ ID NO:2 or 569. The ECD of CTLA-4 contains a single IgSF domain, (i.e., a single IgV domain). In some cases, the IgV domain is or contains amino acids 39-140 of SEQ ID NO:1 (amino acids 4-105 of SEQ ID NO: 2). In some cases, the IgV domain is or contains amino acids 39-152 of SEQ ID NO:1 (amino acids 4-117 of SEQ ID NO:2). Within the IgV domain, there is a CDR1-like loop (corresponding to amino acids 27-34 of SEQ ID NO:2), a CDR2-like loop (corresponding to amino acids 51-55 of SEQ ID NO: 2), and a CDR3-like loop (corresponding to amino acids 97-104 of SEQ ID NO: 2), which, in some aspects, have been reported to play a role in the interaction of CTLA-4 with its CD80 and CD86 cognate ligands (Peach et al., *J. Exp. Med.* (1994), 180(6):2049-2058).

Provided herein are variant CTLA-4 polypeptides that exhibit increased binding activity, such as increased binding affinity, for CD80, CD86 and/or ICOSL. Among the provided embodiments are embodiments directed to variant CTLA-4 molecules that exhibit increased affinity for ICOSL and, in some cases, also exhibit higher binding affinity, such as increased binding affinity, to CD80 and/or CD86. In some embodiments, the binding to CD80, CD86 and ICOSL is competitive, such that a single variant CTLA-4 polypeptide does not bind more than one ligand at a time. Thus, the provided variant CTLA-4 polypeptides are able to bind CD80, CD86 and/or ICOSL to modulate, e.g. antagonize, the normal function of these ligands in binding activating receptors CD28 and ICOS on T cells.

In some aspects, inhibition or attenuation of an immune response, such as a T cell response, could be desirable to reduce or prevent unwanted autoimmune symptoms and/or transplant rejection. Among the provided embodiments are methods for using a variant CTLA-4 polypeptide, such as soluble or cell-expressed form thereof, for treating autoimmunity or an inflammatory disease or condition. In this way, in some aspects, the variant CTLA-4 polypeptide can be delivered to a patient experiencing unwanted autoimmunity, such as involving T cells, with the effect of decreased T cell activation, expansion and/or effector function and attenuation of the autoimmune disorder. Methods of making and using these variant CTLA-4 polypeptides are also provided.

In some cases, various formats of a CTLA-4 polypeptide can be made to promote or increase an immune response. For example, certain CTLA-4-switch receptors containing an activating cytoplasmic signaling domain or decoy receptors that compete for CTLA-4 binding to a cognate binding partner on an effector cell can lead to promotion of an immune response, such as an increase in an immune response. Among the provided embodiments are methods for using a variant CTLA-4 polypeptide, such as certain cell-expressing forms capable of inducing an activating signal and/or competing with an inhibitory signal, for treating cancer and oncology indications.

In some embodiments, the modulation of immune signaling achieved by the provided variant CTLA-4 polypeptides, and immunomodulatory polypeptides, conjugates or engineered cells containing such variant CTLA-4 polypeptides, offers advantages for treatment of inflammatory and autoimmune disorders and other diseases and conditions compared to other treatments. In some cases, therapies to intervene and alter the immunomodulatory effects of such ligand/receptor interactions, and subsequent signaling, are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. Additionally, pharmacokinetic differences between drugs that independently target one of these ligand/receptor interactions can create difficulties in properly maintaining a desired blood concentration of such drug combinations throughout the course of treatment.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names are per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one binding partner (alternatively "counter-structure") compared to the parental wild-type or unmodified (i.e., non-affinity modified) IgSF control domain. Included in this context is an affinity-modified CTLA-4 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wild-type or unmodified IgSF domain. An increase or decrease in binding affinity or avidity can be determined using well-known binding assays such as flow cytometry (Larsen et al., *Am J Transplant,* 5(3): 443-453 (2005); see also, Linsley et al., *Immunity,* 1(9): 793-801 (1994)). An increase in a protein's binding affinity or avidity to its binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value.

An affinity-modified protein is altered in primary amino acid sequence by substitution, addition, or deletion of amino acid residues. The term "affinity modified IgSF domain" is not to be construed as imposing any condition for any particular starting composition or method by which the affinity-modified IgSF domain was created. Thus, the affinity modified IgSF domains of the present invention are not limited to wild-type IgSF domains that are then transformed to an affinity modified IgSF domain by any particular process of affinity modification. An affinity-modified IgSF domain polypeptide can, for example, be generated starting from wild-type mammalian IgSF domain sequence information, then modeled in silico for binding to its binding partner, and finally recombinantly expressed or chemically synthesized to yield the affinity modified IgSF domain composition of matter. In an alternative example, an affinity modified IgSF domain can be created by site-directed mutagenesis of a wild-type IgSF domain. Thus, affinity-modified IgSF domain denotes a product and not necessarily a product produced by any given process. A variety of techniques, including recombinant methods, chemical synthesis, or combinations thereof, may be employed.

The terms "allogenic" or "allogeneic" are used interchangeably herein to mean a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which was removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics, avidity refers to the accumulated strength of multiple affinities of individual non-covalent binding interactions, such as between CTLA-4 and its counter-structures ICOSL, CD80, and/or CD86. As such, avidity is distinct from affinity, which describes the strength of a single interaction. An increase or attenuation in binding affinity of a variant CTLA-4 containing an affinity-modified CTLA-4 IgSF domain to its counter-structure is determined relative to the binding affinity of the unmodified CTLA-4, such as an unmodified CTLA-4 containing the native or wild-type IgSF domain, such as an IgV domain. Methods for determining binding affinity or avidity are known in the art. See, e.g., Larsen et al., *Am J Transplant,* 5(3): 443-453 (2005). In some embodiments, a variant CTLA-4 of the invention (i.e., a CTLA-4 protein containing an affinity modified IgSF domain) specifically binds to ICOSL, CD80, and/or CD86, as measured by flow cytometry, with a binding affinity that yields a Mean Fluorescence Intensity (MFI) value at least 10%, 20%, 30%, 40%, 50%, 60%, 70%, 80%, 90%, or 100% greater than a wild-type CTLA-4 control in a binding assay.

The term "biological half-life" refers to the amount of time it takes for a substance, such as an immunomodulatory polypeptide comprising a variant CTLA-4 of the present invention, to lose half of its pharmacologic or physiologic activity or concentration. Biological half-life can be affected by elimination, excretion, degradation (e.g., enzymatic degradation/digestion) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), extended recombinant peptides sold under the mark XTEN® (Amunix Operating, California, USA) (see WO2013130683), human serum albumin (HSA), bovine serum albumin (BSA), lipids (acylation), poly-Pro-Ala-Ser (PAS), and polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T cell is referred to herein as a "CAR-T cell" or "CAR-T." In some embodiments the CAR-T is a T helper cell, a cytotoxic T cell, a natural killer T cell, a memory T cell, a regulatory T cell, or a gamma delta T-cell. When used clinically, e.g., in adoptive cell transfer, a CAR-T with antigen binding specificity to the patient's tumor, or other tissue of the patient, is typically engineered to express on a T cell obtained from the patient. The engineered T cell expressing the CAR is then infused back into the patient. The CAR-T is thus often an autologous CAR-T although allogeneic CAR-Ts are included within the scope of the invention. The ectodomain (or ECD) of a CAR comprises an antigen binding region, such as an antibody or antigen binding fragment thereof (e.g., single-chain variable fragment (scFv)), that specifically binds under physiological conditions to a target antigen, such as an ECD of an immunomodulatory peptide on a cell surface or a tumor specific antigen. Upon specific binding, a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes (increase or decrease) in cytotoxicity, proliferation or cytokine production. Signal transduction upon CAR-T activation is achieved in some embodiments by a CD3-zeta chain ("CD3-z") endodomain which is involved in signal transduction in native mammalian T-cells. CAR-Ts can further comprise multiple signaling domains such as CD28, 4-1BB or OX40, to further modulate immunomodulatory response of the T cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant CTLA-4 of the invention in an in vitro assay, means the overall cytokine expression level irrespective of the cytokine production induced by individual variant CTLA-4 molecules. In some embodiments, the cytokine being assayed is IFN-gamma, such as in an in vitro primary T-cell assay.

The term "binding partner" (used interchangeably with "counter-structure") in reference to a polypeptide, such as in reference to an IgSF domain of a variant CTLA-4, refers to at least one molecule (typically a native mammalian protein) to which the referenced polypeptide specifically binds under specific binding conditions. In some aspects, a variant CTLA-4, containing an affinity modified IgSF domain, specifically binds to a binding partner of the corresponding native or wildtype CTLA-4 but with increased or attenuated affinity. A "cell surface binding partner" is a binding partner expressed on a mammalian cell surface. Examples of binding partners of variant CTLA-4 molecules provided herein include CD80, CD86 and ICOSL, and particularly human CD80, human CD86 and human ICOSL.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant CTLA-4 polypeptide linked directly or indirectly to one or more chemical moieties or polypeptide is an exemplary conjugate. Such conjugates include fusion proteins, those produced by chemical conjugation and those produced by any other methods.

The term "competitive binding" as used herein means that a protein is capable of specifically binding to at least two binding partners but that specific binding of one binding partner inhibits, such as prevents or precludes, simultaneous binding of the second binding partner. Thus, in some cases, it is not possible for a protein to bind the two binding partners at the same time. Generally, competitive binders contain the same or overlapping binding site for specific binding but this is not a requirement. In some embodiments, competitive binding causes a measurable inhibition (partial or complete) of specific binding of a protein to one of its binding partner due to specific binding of a second binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type CTLA-4 set forth in SEQ ID NO:2 or 569 (ECD) or set forth in SEQ ID NO: 3 (IgV domain) by structural alignment methods as described herein. By aligning the sequences, one skilled in the art can identify corresponding residues, for example, using conserved and identical amino acid residues as guides.

The terms "decrease" or "attenuate" "or suppress" as used herein means to decrease by a statistically significant amount. A decrease can be at least 5%, 10%, 15%, 20%, 25%, 30%, 35%, 40%, 45%, 50%, 55%, 60%, 65%, 70%, 75%, 80%, 85%, 90%, 95%, or 100% of a control value, such as a non-zero control value.

The terms "decreased" or "reduced" as used herein in the context of decreasing immunological activity of a mammalian lymphocyte means to decrease one or more activities of the lymphocyte, as compared to a control, such as an untreated control or a control in which a treatment using an unmodified or non-variant control was employed under the same conditions. A decreased activity can refer to one or more of cell cycle inhibition, reduced cell survival, reduced cell proliferation, reduced cytokine production, or reduced T-cell cytotoxicity, such as by a statistically significant amount. In some embodiments, reference to reduced immunological activity means to reduce interferon gamma (IFN-gamma) production compared to in the absence of treatment, such as by a statistically significant amount. In some embodiments, the immunological activity can be assessed in a mixed lymphocyte reaction (MLR) assay. Methods of conducting MLR assays are known in the art. Wang et al., *Cancer Immunol Res.* (2014) 2(9):846-56. Other methods of assessing activities of lymphocytes are known in the art, including any assay as described herein. In some embodiments an enhancement can be a decrease by at least 5%, 10%, 15%, 20%, 25%, 30%, 35%, 40%, 45%, 50%, 60%, 70%, 80%, 90%, or 100%, as compared to a control value, such as an untreated control value or a non-zero control value.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, PEGylation, lipidation, or Fc-fusion.

As used herein, "domain" (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed, appropriate software can be employed to identify domains.

The term "ectodomain" as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agent(s), yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" (also called "intracellular domain" or "cytoplasmic domain") as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain that mediates or plays a role in signal transduction. Thus, the terms intracellular signaling domain and cytoplasmic signaling domain are used interchangeably.

The terms "enhanced" or "increased" as used herein in the context of increasing immunological activity of a mammalian lymphocyte means to increase one or more activities of the lymphocyte, as compared to a control, such as an untreated control or a control in which a treatment using an unmodified or non-variant control was employed under the same conditions. An increased activity can be one or more of increased cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in an MLR assay. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a control value, such as a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g., T cell, B cell, NK cell) or an antigen presenting cell (e.g., dendritic cell). The cell can be a primary cell from a patient or can be a cell line. In some embodiments, an engineered cell of the invention comprises a variant CTLA-4 provided herein. In some embodiments, the variant CTLA-4 is a transmembrane immunomodulatory protein (hereinafter referred to as "TIP") that is expressed on the engineered cell. In some embodiments, the TIP contains the extracellular domain or a portion thereof containing the IgV domain linked to a transmembrane domain (e.g., a CTLA-4 transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting an immunomodulatory protein as described herein. Among provided engineered cells also are cells further containing an engineered T-cell receptor (TCR) or chimeric antigen receptor (CAR).

The term "engineered T cell" as used herein refers to a T cell such as a T helper cell, cytotoxic T cell (alternatively, cytotoxic T lymphocyte or CTL), natural killer T cell, regulatory T cell, memory T cell, or gamma delta T cell, that has been genetically modified by human intervention such as by recombinant DNA methods or viral transduction methods. An engineered T cell can comprise a variant CTLA-4 transmembrane immunomodulatory protein (TIP) of the present invention that is expressed on the T cell and is engineered to modulate immunological activity of the engineered T cell itself, or a mammalian cell to which the variant CTLA-4 expressed on the T cell specifically binds. An engineered T cell can comprise a variant CTLA-4 secreted immunomodulatory protein (SIP) of the present invention that is expressed by and/or secreted by the T cell and is engineered to modulate immunological activity of the engineered T cell itself, or a mammalian cell to which the variant CTLA-4, when secreted by the T cell, specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), extended recombinant peptides sold under the mark XTEN® (see WO2013130683), human serum albumin (HSA), bovine serum albumin (BSA), lipids (acylation), and poly-Pro-Ala-Ser (PAS), and polyglutamic acid (glutamylation).

The term “immunological synapse” or “immune synapse” as used herein means the interface between a mammalian cell that expresses MHC I (major histocompatibility complex class I) or MHC II, such as an antigen-presenting cell or tumor cell, and a mammalian lymphocyte such as an effector T cell or natural killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody’s effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g., reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information system®, http://www.imgt.org/IMGTScientific-Chart/Numbering/Hu_IGHGnber.html (created: 17 May 2001, last updated: Jun. 8, 2016) and the EU index as reported in Kabat, E. A. et al. Sequences of Proteins of Immunological interest. 5th ed. US Department of Health and Human Services, NIH publication No. 91-3242 (1991).

An immunoglobulin Fc fusion (“Fc-fusion”), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates effector functions and pharmacokinetics) and a variant CTLA-4. An immunoglobulin Fc region may be linked indirectly or directly to one or more variant CTLA-4 or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term “host cell” refers to a cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in dihydrofolate reductase (DHFR). Another example is human embryonic kidney 293 (HEK-293) cells or their derivatives. In some embodiments, a host cell is a mammalian cell (e.g., a human cell, a monkey cell, a hamster cell, a rat cell, a mouse cell, or an insect cell).

The term “immunoglobulin” (abbreviated “Ig”) as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, Fc, and Fd polypeptide fragments. Bispecific antibodies, homobispecific and heterobispecific, are included within the meaning of the term.

The term “immunoglobulin superfamily” or “IgSF” as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into “subfamilies” based on shared properties such as function. Such subfamilies typically consist of from 4 to 30 IgSF members.

The terms “IgSF domain” or “immunoglobulin domain” or “Ig domain” as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC (which either can be an IgC1 or IgC2), or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. CTLA-4 contains one Ig domain: an IgV domain.

The term “IgSF species” as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more of activation, cell survival, apoptosis, cell proliferation, cell cycle inhibition, cytokine production (e.g., interferon-gamma), cytokine release, or T cell cytotoxicity activities. In some cases, an immunological activity can mean the cell expression of cytokines, such as chemokines or interleukins. Assays for determining enhancement or suppression of immunological activity include MLR (mixed lymphocyte reaction) assays measuring interferon-gamma cytokine levels in culture supernatants (Wang et al., Cancer Immunol Res. 2014 Sep.: 2(9):846-56), SEB (staphylococcal enterotoxin B), T cell stimulation assays (Wang et al., *Cancer Immunol Res*, (2014) 2(9):846-56), and anti-CD3 T cell stimulation assays (Li and Kurlander, *J Transl Med*, (2010) 8:104). Since T cell activation is associated with secretion of IFN-gamma cytokine, detecting IFN-gamma levels in culture supernatants from these in vitro human T cell assays can be assayed using commercial ELISA kits (Wu et al., *Immunol Lett* (2008), 117(1):57-62). Induction of an immune response results in an increase in immunological activity relative to quiescent lymphocytes. An immunomodulatory protein, such as a variant CTLA-4 polypeptide containing an affinity modified IgSF domain, as provided herein can in some embodiments decrease or, in alternative embodiments, increase IFN-gamma (interferon-gamma) expression in a primary T cell assay relative to a wild-type IgSF member or IgSF domain control. Those of skill will recognize that the format of the primary T cell assay used to determine an increase in IFN-gamma expression can differ from that employed to assay for a decrease in IFN-gamma expression.

In assaying for the ability of an immunomodulatory protein or affinity modified IgSF domain of the invention to alter IFN-gamma expression in a primary T cell assay, a Mixed Lymphocyte Reaction (MLR) assay can be used. Conveniently, in some cases, a soluble form of an affinity modified IgSF domain of the invention can be employed to determine its ability to increase or decrease the IFN-gamma expression in an MLR. Alternatively, a co-immobilization assay can be used. In a co-immobilization assay, a T-cell receptor signal, provided in some embodiments by an anti-CD3 antibody, is used in conjunction with a co-immobilized affinity modified IgSF domain, such as a variant CTLA-4, to determine the ability to increase or decrease IFN-gamma expression relative to a wild-type IgSF domain control. Methods to assay the immunological activity of engineered cells, including to evaluate the activity of a variant CTLA-4 transmembrane immunomodulatory protein, are known in the art and include, but are not limited to, inhibition or enhancement of T cell expansion or proliferation following antigen stimulation, inhibition of proliferation of primary and secondary allo-stimulated T cells, and autoimmune activities, such as allograft survival assays and anti-donor antibody response assays, in appropriate animal models. Assays also include assays to assess cytotoxicity, including a standard $^{51}$Cr-release assay (see e.g., Milone et al., *Mol Ther* (2009), 17(8):1453-1464) or flow based cytotoxicity assays, or an impedance based cytotoxicity assay (Peper et al. (2014), *J Immunol Methods,* 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein of the invention comprises a variant CTLA-4.

The term "increase" as used herein means to increase by a statistically significant amount. An increase can be at least 5%, 10%, 20%, 30%, 40%, 50%, 75%, 100% greater than a control value, such as a non-zero control value.

An "isoform" of CTLA-4 is one of a plurality of naturally occurring CTLA-4 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of CTLA-4 also refers to the product of different alleles of a CTLA-4 gene.

The term "lymphocyte" as used herein means any of three subtypes of white blood cell in a mammalian immune system. These include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an “integral monotopic protein”. An integral membrane protein that interacts with both lipid bilayers is an “integral polytopic protein” alternatively referred to herein as a “transmembrane protein”.

The terms “modulating” or “modulate” as used herein in the context of an immune response, such as a mammalian immune response, refer to any alteration, such as an increase or a decrease, of existing or potential immune responses that occurs as a result of administration of an immunomodulatory polypeptide comprising a variant CTLA-4 of the present invention or as a result of administration of engineered cells expresses an immunomodulatory protein, such as a variant CTLA-4 transmembrane immunomodulatory protein of the present invention. Thus, it refers to an alteration, such as an increase or decrease, of an immune response as compared to the immune response that occurs or is present in the absence of the administration of the immunomodulatory protein comprising the variant CTLA-4 or cells expressing such an immunomodulatory polypeptide. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils).

Modulation includes any change imparted on an existing immune response, a developing immune response, a potential immune response, or the capacity to induce, regulate, influence, or respond to an immune response. Modulation can be direct or indirect. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type CTLA-4 control in a primary T cell assay (see, Zhao et al. (2016), *Exp Cell Res,* 340(1):132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type CTLA-4 transmembrane protein.

The term “molecular species” as used herein means an ensemble of proteins with identical or substantially identical primary amino acid sequence. Each mammalian immunoglobulin superfamily (IgSF) member defines a collection of identical or substantially identical molecular species. Thus, for example, human CTLA-4 is an IgSF member and each human CTLA-4 molecule is a molecular species of CTLA-4. Variation between molecules that are of the same molecular species may occur owing to differences in post-translational modification, such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A “cell surface molecular species” is a molecular species expressed on the surface of a mammalian cell. Two or more different species of protein, each of which is present exclusively on one or exclusively the other (but not both) of the two mammalian cells forming the IS, are said to be in “cis” or “cis configuration” with each other. Two different species of protein, the first of which is exclusively present on one of the two mammalian cells forming the IS and the second of which is present exclusively on the second of the two mammalian cells forming the IS, are said to be in “trans” or “trans configuration.” Two different species of protein each of which is present on both of the two mammalian cells forming the IS are in both cis and trans configurations on these cells.

The term, a “multimerization domain” refers to a sequence of amino acids that promotes stable interaction of a polypeptide molecule with one or more additional polypeptide molecules, each containing a complementary multimerization domain (e.g., a first multimerization domain and a second multimerization domain), which can be the same or a different multimerization domain. The interactions between complementary multimerization domains, e.g., interaction between a first multimerication domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms “nucleic acid” and “polynucleotide” are used interchangeably to refer to a polymer of nucleic acid residues (e.g., deoxyribonucleotides or ribonucleotides) in either single- or double-stranded form. Unless specifically limited, the terms encompass nucleic acids containing known analogs of natural nucleotides, have similar binding properties, and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a “reference sequence”). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term “non-competitive binding” as used herein means the ability of a protein to specifically bind simultaneously to at least two binding partners. Thus, the protein is able to bind to at least two different binding partners at the same time, although the binding interaction need not be for the same duration such that, in some cases, the protein is specifically bound to only one of the binding partners. In some embodiments, the binding occurs under specific binding conditions. In some embodiments, the simultaneous binding is such that binding of one binding partner does not substantially inhibit simultaneous binding to a second binding partner. In some embodiments, non-competitive binding means that binding a second binding partner to its binding site on the protein does not displace the binding of a first binding partner to its binding site on the protein. Methods of assessing non-competitive binding are well known in the art such as the method described in Perez de la Lastra et al. (1999), *Immunology,* 96(4): 663-670. In some cases, in non-competitive interactions, the first binding partner specifically binds at an interaction site that does not overlap with the interaction site of the second binding partner such that binding of the second binding partner does not directly interfere with the binding of the first binding partner. Thus, any effect on binding of the binding partner by the binding of the second binding partner is through a mechanism other than direct interference with the binding of the first binding partner. For example, in the context of enzyme-substrate interactions, a non-competitive inhibitor binds to a site other than the active site of the enzyme. Non-competitive binding encompasses uncompetitive binding interactions in which a second binding partner specifically binds at an interaction site that does not overlap with the binding of the first binding partner but binds to the second interaction site only when the first interaction site is occupied by the first binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant CTLA-4 or engineered cells expressing a variant CTLA-4 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylation, acetylation, phosphorylation and the like. The terms also include molecules in which one or more amino acid analogs or non-canonical or unnatural amino acids are included as can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art. In a preferred embodiment, the assay used is an anti-CD3 coimmobilization assay. In this assay, primary T cells are stimulated by anti-CD3 immobilized with or without additional recombinant proteins. Culture supernatants are harvested at timepoints, usually 24-72 hours. In another embodiment, the assay used is the MLR. In this assay, primary T cells are stimulated with allogeneic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one binding partner, compared to specific binding for another substrate, such as a different binding partner of the subject protein. Selectivity can be reflected as a ratio of the binding activity (e.g. binding affinity) of a subject protein and a first substrate, such as a first binding partner, (e.g., $K_{d1}$) and the binding activity (e.g. binding affinity) of the same subject protein with a second binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain and/or is not capable of being expressed on the surface of a cell. In some cases, solubility of a protein can be improved by linkage or attachment, directly or indirectly via a linker, to an Fc domain or other moiety, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxy-terminus by no more than 1, 2, or 3 amino acid residues are considered to be of a single species. Such microheterogeneities are a common feature of manufactured proteins.

The term "specific binding fragment" as used herein in reference to a full-length wild-type mammalian CTLA-4 polypeptide or an IgV domain thereof, means a polypeptide having a subsequence of the full-length polypeptide or an IgV domain and that specifically binds in vitro and/or in vivo to a mammalian ICOSL, mammalian CD80, and/or mammalian CD86 such as a human or murine ICOSL, CD80, or CD86. In some embodiments, the specific binding fragment comprises a CTLA-4 IgV subsequence that is at least 60%, 70%, 75%, 80%, 85%, 90%, 95%, 96%, 97%, 98%, or 99% the sequence length of the full-length wild-type sequence or IgV sequence thereof. The specific binding fragment can be altered in sequence to form a variant CTLA-4 of the invention.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays, ForteBio Octet®, or Biacore® measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of less than or less than about $1\times10^{-6}$ M, $1\times10^{-7}$ M, $1\times10^{-8}$ M, $1\times10^{-9}$ M, $1\times10^{-10}$ M or $1\times10^{-11}$ M or less.

The terms "surface expresses" "surface expression" or "expressed on the surface" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising a variant CTLA-4 of the present invention. In some embodiments, the targeting moiety has specific binding affinity for a target molecule, such as a target molecule expressed on a cell. Typically, the target molecule is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, nanobodies, soluble receptors, receptor ligands, affinity matured receptors or ligands, as well as small molecule (<500 dalton) compositions (e.g., specific binding receptor compositions). Targeting moieties can also be attached covalently or non-covalently to the lipid membrane of liposomes that encapsulate a polypeptide of the present invention.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of a therapeutic composition (e.g., containing an immunomodulatory protein or engineered cells) of the invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. "Treating," "treatment," or "therapy" can also mean decreasing inflammation and/or other symptoms associated with transplant rejection.

As used herein in the context of cancer, the terms "treatment" or, "inhibit," "inhibiting" or "inhibition" of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS).

"Preventing," "prophylaxis," or "prevention" of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term "tumor specific antigen" or "TSA" as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant CTLA-4 means a CTLA-4, such as a mammalian (e.g., human or murine) CTLA-4 created by human intervention. The variant CTLA-4 is a polypeptide having an altered amino acid sequence, relative to an unmodified or wild-type CTLA-4. The variant CTLA-4 is a polypeptide which differs from a wild-type CTLA-4 isoform sequence by one or more modifications, such as one or more amino acid substitutions, deletions, additions, or combinations thereof. For purposes herein, the variant CTLA-4 contains at least one affinity modified domain, whereby one or more of the amino acid differences occurs in an IgSF domain (e.g., IgV domain). A variant CTLA-4 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant CTLA-4 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CTLA-4, such as to the sequence of SEQ ID NO:1, a mature sequence thereof (lacking the signal sequence) or a portion thereof containing the extracellular domain or an IgSF domain thereof. In some embodiments, a variant CTLA-4 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CTLA-4 comprising the sequence set forth in SEQ ID NO:2 or SEQ ID NO: 3. Non-naturally occurring amino acids as well as naturally occurring amino acids are included within the scope of permissible substitutions or additions. A variant CTLA-4 is not limited to any particular method of making and includes, for example, de novo chemical synthesis, de novo recombinant DNA techniques, or combinations thereof. A variant CTLA-4 of the invention specifically binds to ICOSL, CD80 and/or CD86 of a mammalian species. In some embodiments, the altered amino acid sequence results in an altered (i.e., increased or decreased) binding affinity or avidity to: ICOSL; CD80; CD86; CD80 and CD86; ICOSL and CD80; ICOSL and CD86; and/or ICOSL, CD80, and CD86, compared to the wild-type or unmodified CTLA-4 protein. An increase or decrease in binding affinity or avidity can be determined using well-known binding assays such as flow cytometry. Such assays are described in Larsen et al., *Am J Transplant,* 5(3):443-453 (2005) and Linsley et al., *Immunity,* 1(9):793-801 (1994).

An increase in variant CTLA-4 binding affinity or avidity to ICOSL, CD80, and/or CD86 is to a value that is at least 5% greater than that of the wild-type or unmodified CTLA-4, and in some embodiments, is at least 10%, 15%, 20%, 30%, 40%, 50%, 100% greater than that of the wild-type or unmodified CTLA-4 control value. A decrease in CTLA-4 binding affinity or avidity to ICOSL, CD80 and/or CD86 is to a value no greater than 95% of the wild-type or unmodified control values, and in some embodiments no greater than 80%, 70% 60%, 50%, 40%, 30%, 20%, 10%, 5%, or no detectable binding affinity or avidity of the wild-type or unmodified control values. A variant CTLA-4 is altered in primary amino acid sequence by substitution, addition, or deletion of amino acid residues.

The term "variant" in the context of a variant CTLA-4 is not to be construed as imposing any condition for any particular starting composition or method by which the variant CTLA-4 is created. A variant CTLA-4 can, for example, be generated starting from wild type mammalian CTLA-4 sequence information, then modeled in silico for binding to ICOSL, CD80, and/or CD86, and, finally, recombinantly expressed or chemically synthesized to yield a variant CTLA-4 of the present invention. In an alternative example, a variant CTLA-4 can be created by site-directed mutagenesis of a wild-type CTLA-4. Thus, variant CTLA-4 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., CTLA-4), IgSF members, host cells, and the like, refers to those which are found in nature and not modified by human intervention.

II. VARIANT CTLA-4 POLYPEPTIDES

Provided herein are variant CTLA-4 polypeptides that exhibit altered (increased or decreased) binding activity or affinity for one or more of a CTLA-4 binding partner. In some embodiments, the CTLA-4 binding partner is one or more of ICOSL, CD80 and/or CD86. In some embodiments, the CTLA-4 binding partner is ICOSL. In some embodiments, the one or more binding partner of CTLA-4 is ICOSL and CD80 or CD86. In some embodiments, the one or more binding partner of CTLA-4 is ICOSL, CD80, and CD86.

CTLA-4 is a member of the immunoglobulin superfamily of proteins, which is a family of proteins that all possess a domain known as an immunoglobulin domain or fold (hereinafter "immunoglobulin superfamily domain" or IgSF domain). In some embodiments, other IgSF family members include those from a Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the other IgSF family members include CD80 (B7-1), CD86 (B7-2), CD274 (PD-L1, B7-H1), PDCD1LG2 (PD-L2, CD273), ICOSLG (B7RP1, CD275, ICOSL, B7-H2), CD276 (B7-H3), VTCN1 (B7-H4), CD28, PDCD1 (TIGIT), ICOS, BTLA (CD272), CD4, CD8A (CD8-alpha), CD8B (CD8-beta), LAG3, HAVCR2 (TIM-3), CEACAM1, TIGIT, PVR (CD155), PVRL2 (CD112), CD226, CD2, CD160, CD200, CD200R1 (CD200R), and NCR3 (NKp30).

Table 1 summarizes exemplary members of the IgSF family. The first column of Table 1 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (*Nucleic Acids Research,* 2013 January; 41(D1):D36-42). The third column provides the region where the indicated IgSF domain is located. The region is specified as a range where the domain is inclusive of the residues defining the range. Column 3 also indicates the IgSF domain class for the specified IgSF region. Column 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 1 is for exemplification only and can be several amino acids (such as one, two, three or four) longer or shorter. Column 5 indicates for some of the listed IgSF members, some of its binding partners.

TABLE 1

IgSF members according to the present disclosure.

| IgSF Member (Synonyms) | NCBI Protein Accession Number/ UniProtKB Protein Identifier | IgSF Region & Domain Class | Other Domains | Binding Partners | IgSF Member Amino Acid Sequence (SEQ ID NO) Precursor (mature residues) | Mature | ECD |
|---|---|---|---|---|---|---|---|
| CD80 (B7-1) | NP_005182.1 P33681 | 35-135, 35-138 or 37-138 IgV, 145-230 or 154-232 IgC | S: 1-34, E: 35-242, T: 243-263, C: 264-288 | CD28, CTLA4, PD-L1 | 443 (35-288) | 470 | 498 |
| CD86 (B7-2) | P42081.2 | 33-131 IgV, 150-225 IgC2 | S: 1-23, E: 24-247, T: 248-268, C: 269-329 | CD28, CTLA4 | 444 (24-329) | 471 | 499 |

TABLE 1-continued

IgSF members according to the present disclosure.

| IgSF Member (Synonyms) | NCBI Protein Accession Number/ UniProtKB Protein Identifier | IgSF Region & Domain Class | Other Domains | Binding Partners | IgSF Member Amino Acid Sequence (SEQ ID NO) Precursor (mature residues) | Mature | ECD |
|---|---|---|---|---|---|---|---|
| CD274 (PD-L1, B7-H1) | Q9NZQ7.1 | 19-127, 24-130 IgV, 133-225 IgC2 | S: 1-18, E: 19-238, T: 239-259, C: 260-290 | PD-1, B7-1 | 445 (19-290) | 472 | 500 |
| PDCD1L G2 (PD-L2, CD273) | Q9BQ51.2 | 21-118 IgV, 122-203 IgC2 | S: 1-19, E: 20-220, T: 221-241, C: 242-273 | PD-1, RGMb | 446 (20-273) | 473 | 501 |
| ICOSLG (B7RP1, CD275, ICOSL, B7-H2) | 075144.2 | 19-129 IgV, 141-227 IgC2 | S: 1-18, E: 19-256, T: 257-277, C: 278-302 | ICOS, CD28, CTLA4 | 447 (19-302) | 474 | 502 |
| CD276 (B7-H3) | Q5ZPR3.1 | 29-139 IgV, 145-238 IgC2, 243-357 IgV2, 367-453, 363-456 IgC2 | S: 1-28, E: 29-466, T: 467-487, C: 488-534 | | 448 (29-534) | 475 | 503 |
| VTCN1 (B7-H4) | Q7Z7D3.1 | 35-146 IgV, 153-241 IgV | S: 1-24, E: 25-259, T: 260-280, C: 281-282 | | 449 (25-282) | 476 | 504 |
| CD28 | P10747.1 | 28-137 IgV | S: 1-18, E: 19-152, T: 153-179, C: 180-220 | B7-1, B7-2, B7RP1 | 450 (19-220) | 477 | 505 |
| CTLA4 | AAL07473.1 P16410.3 | 39-152 IgV 39-140 IgV | S: 1-35, E: 36-161, T: 162-182, C: 183-223 | B7-1, B7-2, B7RP1 | 1 (36-223) | 478 | 2 |
| PDCD1 (PD-1) | Q15116.3 | 35-145 IgV | S: 1-20, E: 21-170, T: 171-191, C: 192-288 | PD-L1, PD-L2 | 451 (21-288) | 479 | 506 |
| ICOS | Q9Y6W8.1 | 30-132 IgV | S: 1-20, E: 21-140, T: 141-161, C: 162-199 | B7RP1 | 452 (21-199) | 480 | 507 |
| BTLA (CD272) | Q7Z6A9.3 | 31-132 IgV | S: 1-30, E: 31-157, T: 158-178, C: 179-289 | HVEM | 453 (31-289) | 481 | 508 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | 454 (26-458) | 482 | 509 |
| CD8A (CD8-alpha) | P01732.1 | 22-135 IgV | S: 1-21, E: 22-182, T: 183-203, C: 204-235 | MHC class I | 455 (22-235) | 483 | 510 |
| CD8B (CD8-beta) | P10966.1 | 22-132 IgV | S: 1-21, E: 22-170, T: 171-191, C: 192-210 | MHC class I | 456 (22-210) | 484 | 511 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | 457 (29-525) | 485 | 512 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | 458 (22-301) | 486 | 513 |
| CEACAM1 | P13688.2 | 35-142 IgV, 145-232 IgC2, 237-317 IgC2, 323-413 IgCs | S: 1-34, E: 35-428, T: 429-452, C: 453-526 | TIM-3 | 459 (35-526) | 487 | 514 |
| TIGIT | Q495A1.1 | 22-124 IgV | S: 1-21, E: 22-141, T: 142-162, C: 163-244 | CD155, CD112 | 460 (22-244) | 488 | 515 |

TABLE 1-continued

IgSF members according to the present disclosure.

| IgSF Member (Synonyms) | NCBI Protein Accession Number/ UniProtKB Protein Identifier | IgSF Region & Domain Class | Other Domains | Binding Partners | IgSF Member Amino Acid Sequence (SEQ ID NO) Precursor (mature residues) | Mature | ECD |
|---|---|---|---|---|---|---|---|
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | 461 (21-417) | 489 | 516 |
| PVRL2 (CD 112) | Q92692.1 | 32-156 IgV, 162-256 IgC2, 261-345 IgC2 | S: 1-31, E: 32-360, T: 361-381, C: 382-538 | TIGIT, CD226, CD112R | 462 (32-538) | 490 | 517 |
| CD226 | Q15762.2 | 19-126 IgC2, 135-239 IgC2 | S: 1-18, E: 19-254, T: 255-275, C: 276-336 | CD155, CD112 | 463 (19-336) | 491 | 518 |
| CD2 | P06729.2 | 25-128 IgV, 129-209 IgC2 | S: 1-24, E: 25-209, T: 210-235, C: 236-351 | CD58 | 464 (25-351) | 492 | 519 |
| CD 160 | 095971.1 | 27-122 IgV | N/A | HVEM, MHC family of proteins | 465 (27-159) | 493 | 520 |
| CD200 | P41217.4 | 31-141 IgV, 142-232 IgC2 | S: 1-30, E: 31-232, T: 233-259, C: 260-278 | CD200R | 466 (31-278) | 494 | 521 |
| CD200R1 (CD200R) | Q8TD46.2 | 53-139 IgV, 140-228 IgC2 | S: 1-28, E: 29-243, T: 244-264, C: 265-325 | CD200 | 467 (29-325) | 495 | 522 |
| NCR3 (NKp30) | 014931.1 | 19-126 IgC-like | S: 1-18, E: 19-135, T: 136-156, C: 157-201 | B7-H6 | 468 (19-201) | 496 | 523 |
| VSIG8 | Q5VU13 | 22-141 IgV 1 146-257 IgV 2 | S: 1-21 E: 22-263 T: 264-284 C: 285-414 | VISTA | 469 (22-414) | 497 | 524 |

In some embodiments, the variant CTLA-4 polypeptide contains one or more amino acid modifications, such as one or more substitutions (alternatively, "mutations" or "replacements"), deletions or additions, in an immunoglobulin superfamily (IgSF) domain (IgD) relative to a wild-type or unmodified CTLA-4 polypeptide or a portion of a wild-type or unmodified CTLA-4 containing the IgD or a specific binding fragment thereof. Thus, a provided variant CTLA-4 polypeptide is or comprises a variant IgD (hereinafter called "vIgD") in which the one or more amino acid modifications (e.g., substitutions) is in an IgD.

In some embodiments, the IgD comprises an IgV domain or specific binding fragment of the IgV domain, or combinations thereof. In some embodiments, the IgD can be an IgV only or the entire extracellular domain (ECD) of CTLA-4. In some embodiments, the IgD comprises a specific binding fragment of the ECD. Table 1 provides exemplary residues that correspond to the IgV region and ECD of CTLA-4. In some embodiments, the variant CTLA-4 polypeptide contains an IgV domain or an ECD or specific binding fragments thereof in which the at least one of the amino acid modifications (e.g., substitutions) is in the IgV domain or ECD or a specific binding fragment thereof. In some embodiments, the variant CTLA-4 polypeptide contains an IgV domain or specific binding fragments thereof in which the at least one of the amino acid modifications (e.g., substitutions) is in the IgV domain or a specific binding fragment thereof. In some embodiments, the variant CTLA-4 polypeptide contains an ECD or specific binding fragments thereof in which the at least one of the amino acid modifications (e.g., substitutions) is in the ECD or a specific binding fragment thereof. In some embodiments, by virtue of the altered binding activity or affinity, the altered IgV domain or ECD is an affinity-modified IgSF domain.

In some embodiments, the variant is modified in one more IgSF domains relative to the sequence of an unmodified CTLA-4 sequence. In some embodiments, the unmodified CTLA-4 sequence is a wild-type CTLA-4. In some embodiments, the unmodified or wild-type CTLA-4 has the sequence of a native CTLA-4 or an ortholog thereof. In some embodiments, the unmodified CTLA-4 is or comprises the extracellular domain (ECD) of CTLA-4 or a portion thereof containing one or more IgSF domain (see Table 1). In some embodiments, the extracellular domain of an unmodified or wild-type CTLA-4 polypeptide comprises an IgV domain or a specific binding fragment thereof. In some embodiments, the variant CTLA-4 polypeptide comprises or consists essentially of the IgV domain or a specific binding fragment thereof. In some embodiments, the variant CTLA-4 polypeptide comprises or consists essentially of the ECD or a specific binding fragment thereof. In some embodiments, the variant CTLA-4 is soluble and lacks a transmembrane domain. In some embodiments, the variant CTLA-4 further comprises a transmembrane domain and, in some cases, also a cytoplasmic domain, which can contain an intracellular signaling domain.

In some embodiments, the wild-type or unmodified CTLA-4 sequence is a mammalian CTLA-4 sequence. In some embodiments, the wild-type or unmodified CTLA-4 sequence can be a mammalian CTLA-4 that includes, but is not limited to, human, mouse, cynomolgus monkey, or rat CTLA-4. In some embodiments, the wild-type or unmodified CTLA-4 sequence is human.

In some embodiments, the wild-type or unmodified CTLA-4 sequence has (i) the sequence of amino acids set forth in SEQ ID NO: 1 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1 or the mature form thereof, or (iii) is a portion of (i) or (ii) containing an IgV domain or ECD or specific binding fragments thereof.

In some embodiments, the wild-type or unmodified CTLA-4 sequence is or comprises an extracellular domain (ECD) of the CTLA-4 or a portion thereof. In some embodiments, the unmodified or wild-type CTLA-4 polypeptide comprises the amino acid sequence set forth in SEQ ID NO: 2 (corresponding to amino acid residues 36-161 of SEQ ID NO: 1), or an ortholog thereof. In some cases, the unmodified or wild-type CTLA-4 polypeptide can comprise (i) the sequence of amino acids set forth in SEQ ID NO: 2, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 2, or (iii) is a specific binding fragment of the sequence of (i) or (ii) comprising an IgV domain. In some embodiments, the wild-type or unmodified ECD is capable of binding one or more CTLA-4 binding partners, such as ICOSL and/or one or more of CD80 and/or CD86.

In some embodiments, the wild-type or unmodified CTLA-4 polypeptide comprises an IgV domain, or a specific binding fragment thereof. In some embodiments, the IgV domain of the wild-type or unmodified CTLA-4 polypeptide comprises the amino acid sequence set forth in SEQ ID NO: 3 (corresponding to amino acid residues 39-140 of SEQ ID NO: 1), or an ortholog thereof. For example, the IgV domain of the unmodified or wild-type CTLA-4 polypeptide can contain (i) the sequence of amino acids set forth in SEQ ID NO: 3, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 3, or (iii) a specific binding fragment of the sequence of (i) or (ii). In some embodiments, the wild-type or unmodified IgV domain is capable of binding one or more CTLA-4 binding partners, such as ICOSL and/or one or more of CD80 and/or CD86.

In some embodiments, the wild-type or unmodified CTLA-4 polypeptide contains a specific binding fragment of CTLA-4, such as a specific binding fragment of the IgV domain or ECD. In some embodiments the specific binding fragment can bind ICOSL. In some embodiments, the specific fragment can bind ICOSL and CD80 or CD86. In some embodiments, the specific fragment can bind ICOSL, CD80 and CD86. The specific binding fragment can have an amino acid length of at least 50 amino acids, such as at least 60, 70, 80, 90, or 100 amino acids. In some embodiments, a specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 39-140 of SEQ ID NO: 1. In some embodiments, a specific binding fragment of the ECD comprises an amino acid sequence that is at least about 85%, 86%, 87%, 88%, 89%, 90%, 91%, 92%, 93%, 94%, 95%, 96%, 97%, 98%, 99% of the length of the ECD set forth as amino acids 36-161 of SEQ ID NO: 1.

In some embodiments, the variant CTLA-4 polypeptide comprises the ECD domain or a portion thereof comprising one or more affinity modified IgSF domains. In some embodiments, the variant CTLA-4 polypeptides can comprise an IgV domain, or a specific binding fragment of the IgV domain or a specific binding fragment of the ECD in which one or more of the IgSF domain (IgV) or ECD contains the one or more amino acid modifications (e.g., substitutions). In some embodiments, the variant CTLA-4 polypeptide comprises a full-length IgV domain. In some embodiments, the variant CTLA-4 polypeptide comprises a full-length ECD. In some embodiments, the variant CTLA-4 polypeptide comprises a specific binding fragment of the IgV domain. In some embodiments, the variant CTLA-4 polypeptide comprises a specific binding fragment of the ECD.

In any of such embodiments, the one or more amino acid modifications (e.g., substitutions) of the variant CTLA-4 polypeptides can be located in the CTLA-4 polypeptide ECD, such as in an IgSF domain therein. For example, in some embodiments, one or more amino acid modifications (e.g., substitutions) are located in the extracellular domain of the variant CTLA-4 polypeptide. In some embodiments, one or more amino acid modifications (e.g., substitutions) are located in the IgV domain or specific binding fragment of the IgV domain.

Generally, each of the various attributes of polypeptides are separately disclosed below (e.g., soluble and membrane bound polypeptides, affinity of CTLA-4 for ICOSL; CD80 and/or CD86, number of variations per polypeptide chain, number of linked polypeptide chains, the number and nature of amino acid alterations per variant CTLA-4, etc.) However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain, or ECD, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

A. Exemplary Modifications

Provided herein are variant CTLA-4 polypeptides containing modifications in the ECD, an IgSF domain thereof or a specific binding fragment thereof, relative to an IgSF or ECD contained in a wild-type or unmodified CTLA-4 polypeptide. In some embodiments, at least one modification is in an IgSF domain (e.g., IgV) or a specific binding fragment thereof, such that the provided variant CTLA-4 polypeptide contains at least one affinity-modified IgSF domain or a specific binding fragment thereof. In some embodiments, the variant CTLA-4 polypeptide exhibits altered (increased or decreased) binding activity or affinity for ICOSL, CD80 and/or CD86 compared to a wild-type or unmodified CTLA-4 polypeptide. The ICOSL, CD80, and/or CD86 can be a mammalian protein, such as a human protein or a murine protein.

In some embodiments, the variant CTLA-4 polypeptide exhibits altered (increased or decreased) binding activity or affinity for ICOSL and, optionally, one or more ligands CD80 and CD86 compared to a wild-type or unmodified CTLA-4 polypeptide. In some embodiments, a variant CTLA-4 polypeptide has a binding affinity for ICOSL, and optionally CD80 and/or CD86, that differs from that of a wild-type or unmodified CTLA-4 polypeptide control (e.g., unmodified) sequence as determined by, for example, solid-phase ELISA immunoassays, flow cytometry, ForteBio Octet® or Biacore assays. In some embodiments, the variant CTLA-4 polypeptide has an increased binding affinity for ICOSL, and optionally CD80 and/or CD86. In some embodiments, the variant CTLA-4 polypeptide has an increased binding affinity for ICOSL, and optionally a decreased binding affinity for one or more CD80 and/or CD86, relative to a wild-type or unmodified CTLA-4 polypeptide.

In some embodiments, the variant CTLA-4 polypeptide exhibits altered (increased or decreased) binding activity or affinity for CD80 and, optionally, one or more ligands ICOSL and CD86 compared to a wild-type or unmodified CTLA-4 polypeptide. In some embodiments, a variant CTLA-4 polypeptide has a binding affinity for CD80, and optionally ICOSL and/or CD86, that differs from that of a wild-type or unmodified CTLA-4 polypeptide control (e.g., unmodified) sequence as determined by, for example, solid-phase ELISA immunoassays, flow cytometry, ForteBio Octet® or Biacore assays. In some embodiments, the variant CTLA-4 polypeptide has an increased binding affinity for CD80, and optionally ICOSL and/or CD86. In some embodiments, the variant CTLA-4 polypeptide has an increased binding affinity for CD80, and optionally a decreased binding affinity for one or more ICOSL and/or CD86, relative to a wild-type or unmodified CTLA-4 polypeptide.

In some embodiments, the variant CTLA-4 polypeptide exhibits altered (increased or decreased) binding activity or affinity for CD86 and, optionally, one or more ligands ICOSL and CD80 compared to a wild-type or unmodified CTLA-4 polypeptide. In some embodiments, a variant CTLA-4 polypeptide has a binding affinity for CD86, and optionally ICOSL and/or CD80, that differs from that of a wild-type or unmodified CTLA-4 polypeptide control (e.g., unmodified) sequence as determined by, for example, solid-phase ELISA immunoassays, flow cytometry, ForteBio Octet® or Biacore assays. In some embodiments, the variant CTLA-4 polypeptide has an increased binding affinity for CD86, and optionally ICOSL and/or CD80. In some embodiments, the variant CTLA-4 polypeptide has an increased binding affinity for CD86, and optionally a decreased binding affinity for one or more ICOSL and/or CD80, relative to a wild-type or unmodified CTLA-4 polypeptide.

Binding affinities for each of the binding partners are independent. That is, in some embodiments, a variant CTLA-4 polypeptide has an increased binding affinity for one, two or three of ICOSL, CD80, and/or CD86, and a decreased binding affinity for one, two or three of ICOSL, CD80, and/or CD86, relative to a wild-type or unmodified CTLA-4 polypeptide.

In some embodiments, the variant CTLA-4 polypeptide has an increased binding affinity for CD86, relative to a wild-type or unmodified CTLA-4 polypeptide. In some embodiments, the variant CTLA-4 polypeptide has an increased binding affinity for CD80, relative to a wild-type or unmodified CTLA-4 polypeptide. In some embodiments, the variant CTLA-4 polypeptide has an increased binding affinity for CD80 and CD86, relative to a wild-type or unmodified CTLA-4 polypeptide. In some embodiments, such a variant CTLA-4 polypeptide also has an increased binding affinity for ICOSL, relative to a wild-type or unmodified CTLA-4 polypeptide.

In some embodiments, the variant CTLA-4 polypeptide has an increased binding affinity for ICOSL, relative to a wild-type or unmodified CTLA-4 polypeptide. In some embodiments, the variant CTLA-4 polypeptide has an increased or decreased binding affinity for ICOSL and increased binding affinity for CD80, relative to a wild-type or unmodified CTLA-4 polypeptide. In some embodiments, the variant CTLA-4 polypeptide has an increased or decreased binding affinity for ICOSL and an increased binding affinity for CD86, relative to a wild-type or unmodified CTLA-4 polypeptide. In some embodiments, the variant CTLA-4 polypeptide has a decreased binding affinity for ICOSL, relative to a wild-type or unmodified CTLA-4 polypeptide. In some embodiments, the variant CTLA-4 polypeptide has an increased or decreased binding affinity for ICOSL and a decreased binding affinity for CD80, relative to a wild-type or unmodified CTLA-4 polypeptide. In some embodiments, the variant CTLA-4 polypeptide has an increased or decreased binding affinity for ICOSL and a decreased binding affinity for CD86, relative to a wild-type or unmodified CTLA-4 polypeptide.

In some embodiments, the variant CTLA-4 polypeptide has an increased binding affinity for ICOSL and CD80, relative to a wild-type or unmodified CTLA-4 polypeptide. In some embodiments, the variant CTLA-4 polypeptide has an increased binding affinity for ICOSL and a decreased binding affinity for CD80, relative to a wild-type or unmodified CTLA-4 polypeptide. In some embodiments, the variant CTLA-4 polypeptide has a decreased binding affinity for ICOSL and CD80, relative to a wild-type or unmodified CTLA-4 polypeptide. In some embodiments, the variant CTLA-4 polypeptide has a decreased binding affinity for ICOSL and an increased binding affinity for CD80, relative to a wild-type or unmodified CTLA-4 polypeptide.

In some embodiments, the variant CTLA-4 polypeptide has an increased binding affinity for ICOSL and CD86, relative to a wild-type or unmodified CTLA-4 polypeptide. In some embodiments, the variant CTLA-4 polypeptide has an increased binding affinity for ICOSL and a decreased binding affinity for CD86, relative to a wild-type or unmodified CTLA-4 polypeptide. In some embodiments, the variant CTLA-4 polypeptide has a decreased binding affinity for ICOSL and CD86, relative to a wild-type or unmodified CTLA-4 polypeptide. In some embodiments, the variant CTLA-4 polypeptide has a decreased binding affinity for ICOSL and an increased binding affinity for CD86, relative to a wild-type or unmodified CTLA-4 polypeptide.

In some embodiments, the variant CTLA-4 polypeptide has an increased binding affinity for ICOSL, CD80, and CD86, relative to a wild-type or unmodified CTLA-4 polypeptide. In some embodiments, the variant CTLA-4 polypeptide has an increased binding affinity for ICOSL and CD80, and a decreased binding affinity for CD86, relative to a wild-type or unmodified CTLA-4 polypeptide. In some embodiments, the variant CTLA-4 polypeptide has an increased binding affinity for ICOSL and CD86, and a decreased binding affinity for CD80, relative to a wild-type or unmodified CTLA-4 polypeptide. In some embodiments, the variant CTLA-4 polypeptide has a decreased binding affinity for ICOSL and CD80, and an increased binding affinity for CD86, relative to a wild-type or unmodified CTLA-4 polypeptide. In some embodiments, the variant CTLA-4 polypeptide has a decreased binding affinity for ICOSL and an increased binding affinity for CD80 and CD86, relative to a wild-type or unmodified CTLA-4 polypeptide. In some embodiments, the variant CTLA-4 polypeptide has an increased binding affinity for ICOSL, and a decreased binding affinity for CD80 and CD86, relative to a wild-type or unmodified CTLA-4 polypeptide. In some embodiments, the variant CTLA-4 polypeptide has a decreased binding affinity for ICOSL, CD80, and CD86, relative to a wild-type or unmodified CTLA-4 polypeptide. In some embodiments, the variant CTLA-4 polypeptide has a decreased binding affinity for ICOSL, and an increased binding affinity for CD80 and CD86, relative to a wild-type or unmodified CTLA-4 polypeptide.

In some embodiments, a variant CTLA-4 polypeptide with increased or greater binding affinity to ICOSL, CD80, and/or CD86, will have an increase in binding affinity relative to the wild-type or unmodified CTLA-4 polypeptide control of at least about 5%, such as at least about 10%, 15%, 20%, 25%, 35%, or 50% for the ICOSL, CD80, and/or CD86. In some embodiments, the increase in binding affinity relative to the wild-type or unmodified CTLA-4 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CTLA-4 polypeptide has the same sequence as the variant CTLA-4 polypeptide except that it does not contain the one or more amino acid modifications (e.g., substitutions).

In some embodiments, a variant CTLA-4 polypeptide with reduced or decreased binding affinity to ICSOL, CD80, and/or CD86 will have a decrease in binding affinity relative to the wild-type or unmodified CTLA-4 polypeptide control of at least 5%, such as at least about 10%, 15%, 20%, 30%, 40%, 50%, 60%, 70%, 80%, 90% or more for the ICOSL, CD80, and/or CD86. In some embodiments, the decrease in binding affinity relative to the wild-type or unmodified CTLA-4 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CTLA-4 polypeptide has the same sequence as the variant CTLA-4 polypeptide except that it does not contain the one or more amino acid modifications (e.g., substitutions).

In some embodiments, the equilibrium dissociation constant ($K_D$) of any of the foregoing embodiments to ICOSL, CD80, and/or CD86 can be less than $1\times10^{-5}$ M, $1\times10^{-6}$ M, $1\times10^{-7}$ M, $1\times10^{-8}$ M, $1\times10^{-9}$ M, $1\times10^{-1}$° M or $1\times10^{-11}$M, or $1\times10^{-12}$ M or less.

The wild-type or unmodified CTLA-4 sequence does not necessarily have to be used as a starting composition to generate variant CTLA-4 polypeptides described herein. Therefore, use of the term "modification", such as "substitution" does not imply that the present embodiments are limited to a particular method of making variant CTLA-4 polypeptides. Variant CTLA-4 polypeptides can be made, for example, by de novo peptide synthesis and thus does not necessarily require a modification, such as a "substitution" in the sense of altering a codon to encode for the modification, e.g. substitution. This principle also extends to the terms "addition" and "deletion" of an amino acid residue which likewise do not imply a particular method of making. The means by which the variant CTLA-4 polypeptides are designed or created is not limited to any particular method. In some embodiments, however, a wild-type or unmodified CTLA-4 encoding nucleic acid is mutagenized from wild-type or unmodified CTLA-4 genetic material and screened for desired specific binding affinity and/or inhibition or reduction of IFN-gamma expression or other functional activity.

In some embodiments, a variant CTLA-4 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid modification(s) are designated by amino acid position number corresponding to the numbering of positions of the unmodified ECD sequence set forth in SEQ ID NO:2 or, where applicable, the unmodified ECD sequence set forth in SEQ ID NO: 569 as follows:

```
                                               (SEQ ID NO: 2)
KAMHVAQPAVVLASSRGIASFVCEYASPGKATEVRVTVLRQADSQVTEVCA

ATYMMGNELTFLDDSICTGTSSGNQVNLTIQGLRAMDTGLYICKVELMYPP

PYYLGIGNGTQIYVIDPEPCPDSD

                                             (SEQ ID NO: 569)
KAMHVAQPAVVLASSRGIASFVCEYASPGKATEVRVTVLRQADSQVTEVCA

ATYMMGNELTFLDDSICTGTSSGNQVNLTIQGLRAMDTGLYICKVELMYPP

PYYLGIGNGTQIYVIDPEPCPDSDQ
```

In some embodiments, the variant CTLA-4 polypeptide contains any one or more of the provided amino acid modifications, e.g., amino acid substitutions, with reference to SEQ ID NO:2 or 569, or a specific binding fragment thereof. In some embodiments, the variant CTLA-4 polypeptide contains any one or more of the provided amino acid modifications in a polypeptide that is or includes an IgV domain or a specific binding fragment thereof, such as in the exemplary sequence set forth in SEQ ID NO:3.

```
                                               (SEQ ID NO: 3)
HVAQPAVVLASSRGIASFVCEYASPGKATEVRVTVLRQADSQVTEVCAATY

MMGNELTFLDDSICTGTSSGNQVNLTIQGLRAMDTGLYICKVELMYPPPYY
```

It is within the level of a skilled artisan to identify the corresponding position of a modification, e.g., amino acid substitution, in a CTLA-4 polypeptide, including portion thereof containing an IgSF domain (e.g., IgV) thereof, such as by alignment of a reference sequence (e.g., SEQ ID NO:3) with SEQ ID NO:2 or SEQ ID NO:569. In the listing of modifications throughout this disclosure, the amino acid position is indicated in the middle, with the corresponding unmodified (e.g., wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g., wild-type) amino acid listed before and after the number and the identified variant amino acid insertion listed after the unmodified (e.g., wild-type) amino acid.

In some embodiments, the variant CTLA-4 polypeptide has one or more amino acid modification, e.g., substitutions in a wild-type or unmodified CTLA-4 sequence. The one or more amino acid modification, e.g., substitutions can be in the ectodomain (extracellular domain) of the wild-type or unmodified CTLA-4 sequence. In some embodiments, the one or more amino acid modification, e.g. substitutions are in the IgV domain or specific binding fragment thereof.

In some embodiments, the variant CTLA-4 polypeptide has up to 1, 2, 3, 4, 5, 6, 7, 8, 9, 10, 11, 12, 13, 14, 15, 16, 17, 18, 19, or 20 amino acid modification, e.g., substitutions. The substitutions can be in the IgV domain or the ECD. In some embodiments, the variant CTLA-4 polypeptide has up to 1, 2, 3, 4, 5, 6, 7, 8, 9, 10, 11, 12, 13, 14, 15, 16, 17, 18, 19, or 20 amino acid modification, e.g., substitutions in the IgV domain or specific binding fragment thereof. In some embodiments, the variant CTLA-4 polypeptide has up to 1, 2, 3, 4, 5, 6, 7, 8, 9, 10, 11, 12, 13, 14, 15, 16, 17, 18, 19, or 20 amino acid modification, e.g., substitutions in the ECD or a specific binding fragment thereof. In some embodiments, the variant CTLA-4 polypeptide has at least about 85%, 86%, 86%, 88%, 89%, 90%, 91%, 92%, 93%, 94%, 95%, 96%, 97%, 98%, or 99% sequence identity with the wild-type or unmodified CTLA-4 polypeptide or specific binding fragment thereof, such as with the amino acid sequence of SEQ ID NO: 2 or 3.

In some embodiments, the variant CTLA-4 polypeptide has one or more amino acid modification, e.g., substitutions in an unmodified CTLA-4 or specific binding fragment thereof corresponding to position(s) 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67, 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, 122, 124, 125, and/or 126 with reference to positions set forth in SEQ ID NO:2.

In some embodiments, the variant CTLA-4 polypeptide has one or more amino acid modification, e.g., substitutions in an unmodified CTLA-4 or specific binding fragment thereof corresponding to position(s) 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67, 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, and/or 122 with reference to positions set forth in SEQ ID NO:2.

In some embodiments, the variant CTLA-4 polypeptide has one or more amino acid modification, e.g. substitutions in an unmodified CTLA-4 or specific binding fragment thereof corresponding to position(s) 12, 18, 26, 29, 33, 53, 55, 56, 58, 63, 72, 87, 98, 99, 105, 106, and/or 117 with reference to positions set forth in SEQ ID NO:2.

In some embodiments, the variant CTLA-4 polypeptide has one or more amino acid modification, e.g. substitutions in an unmodified CTLA-4 or specific binding fragment thereof corresponding to position(s) 12, 18, 26, 29, 56, 63, 72, 98, 99, 105, 106, and/or 117 with reference to positions set forth in SEQ ID NO:2.

In some embodiments, the variant CTLA-4 polypeptide has one or more amino acid modifications selected from A6T, V10A, L12F, L12H, L12I, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V961, E97Q, L98Q, L98R, M991, M99L, P102L, Y105F, Y105L, L106I, L106N, L106R, L106V, I108F, I108V, N110K, N110S, N110Y, Q113H, Y115H, Y115N, V116A, I117E, I117K, I117L, I117M, I117T, P119H, E120D, P121S, C122P, D124P, D124I, S125I, S125P, D126P, and/or D126T with reference to positions set forth in SEQ ID NO:2, or a conservative amino acid substitution thereof.

In some embodiments, the variant CTLA-4 polypeptide has one or more amino acid modifications selected from A6T, V10A, L12F, L12H, L12P, S14N, S15P, R16C, R16G, R16H, I18A, I18F, I18N, I18T, I18V, A19V, S20N, V22A, V221, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, 167V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V961, E97Q, L98Q, L98R, M991, M99L, Y105F, Y105L, L106I, L106R, I108F, I108V, N110K, N110S, N110Y, Y115N, V116A, I117E, I117L, I117M, and/or I117T with reference to positions set forth in SEQ ID NO:2, or a conservative amino acid substitution thereof.

In some embodiments, the variant CTLA-4 polypeptide has one or more amino acid modifications selected from L12F, L12H, L12I, L12P, I18A, I18F, I18N, I18T, I18V, A26D, A26S, A26T, G29R, G29W, E33M, E33V, T53S, M55R, M55T, M55V, M56K, M56L, M56R, M56T, M56V, N58D, N58S, L63H, L63P, S72G, S72T, M87A, M87K, M87T, M87V, L98Q, L98R, M991, M99L, Y105F, Y105L, L106I, L106N, L106R, L106V, I117E, I117K, I117L, I117M, and/or I117T, with reference to positions set forth in SEQ ID NO:2, or a conservative amino acid substitution thereof. In some embodiments, the variant CTLA-4 polypeptide has one or more amino acid modifications selected from 112F, L12P, I18T, A26T, G29W, T53S, M55T, M56K, M56T, N58S, S72G, M99L, L63P, L98Q, Y105L, L106I, and/or I117L, with reference to positions set forth in SEQ ID NO:2, or a conservative amino acid substitution thereof. In some embodiments, the variant CTLA-4 polypeptide has one or more amino acid modifications selected from L12P, I18T, A26T, G29W, T53S, M55T, M56K, N58S, S72G, M99L, L63P, L98Q, Y105L, L106I, and/or I117L, with reference to positions set forth in SEQ ID NO:2, or a conservative amino acid substitution thereof. In some embodiments, the variant CTLA-4 polypeptide has one or more amino acid modifications selected from A26T, G29W, L63P, S72G, L98Q, M99L, Y105L and/or L106I, with reference to positions set forth in SEQ ID NO:2, or a conservative amino acid substitution thereof.

A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant CTLA-4 polypeptide comprises an amino acid substitution in an unmodified or wild-type CTLA-4 polypeptide or specific binding fragment thereof corresponding to A26T. In some embodiments, the variant CTLA-4 polypeptide further contains one or more amino acid substitutions G29W, T53S, L63P, S72G, L98Q, M99L, Y105L and/or L106I. In some embodiments, the variant CTLA-4 polypeptide contains the amino acid substitutions A26T/G29W, A26T/T53S, A26T/L63P, A26T/S72G, A26T/L98Q, A26T/M99L, A26T/Y105L, A26T/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to G29W. In some embodiments, the variant CTLA-4 polypeptide further contains one or more amino acid substitutions A26T, T53S, L63P, S72G, L98Q, M99L, Y105L and/or L106I. In some embodiments, the variant CTLA-4 polypeptide contains the amino acid substitutions A26T/G29W, G29W/T53S, G29W/L63P, G29W/S72G, G29W/L98Q, G29W/M99L, G29W/Y105L, or G29W/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to T53S. In some embodiments, the variant CTLA-4 polypeptide further contains one or more amino acid substitutions A26T, G29W, L63P, S72G, L98Q, M99L, Y105L and/or L106I. In some embodiments, the variant CTLA-4 polypeptide contains the amino acid substitutions A26T/T53S, G29W/T53S, T53S/L63P, T53S/S72G, T53S/L98Q, T53S/M99L, T53S/Y105L, or T53S/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to L63P. In some embodiments, the variant CTLA-4 polypeptide further contains one or more amino acid substitutions A26T, G29W, T53S, S72G, L98Q, M99L, Y105L and/or L106I. In some embodiments, the variant CTLA-4 polypeptide contains the amino acid substitutions A26T/L63P, G29W/L63P, T53S/L63P, L63P/S72G, L63P/L98Q, L63P/M99L, L63P/Y105L, or L63P/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to S72G. In some embodiments, the variant CTLA-4 polypeptide further contains one or more amino acid substitutions A26T, G29W, T53S, L63P, L98Q, M99L, Y105L and/or L106I. In some embodiments, the variant CTLA-4 polypeptide contains the amino acid substitutions A26T/S72G, G29W/S72G, T53S/S72G, L63P/S72G, S72G/L98Q, S72G/M99L, S72G/Y105L or S72G/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to L98Q. In some embodiments, the variant CTLA-4 polypeptide further contains one or more amino acid substitutions A26T, G29W, T53S, L63P, S72G, M99L, Y105L and/or L106I. In some embodiments, the variant CTLA-4 polypeptide contains the amino acid substitutions A26T/L98Q, G29W/L98Q, T53S/L98Q, L63P/L98Q, S72G/L98Q, L98Q/M99L, L98Q/Y105L or L98Q/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to M99L. In some embodiments, the variant CTLA-4 polypeptide further contains one or more amino acid substitutions A26T, G29W, T53S, L63P, S72G, L98Q, Y105L and/or L106I. In some embodiments, the variant CTLA-4 polypeptide contains the amino acid substitutions A26T/M99L, G29W/M99L, T53S/M99L, L63P/M99L, S72G/M99L, L98Q/M99L, M99L/Y105L or M99L/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to Y105L. In some embodiments, the variant CTLA-4 polypeptide further contains one or more amino acid substitutions A26T, G29W, T53S, L63P, S72G, L98Q, M99L and/or L106I. In some embodiments, the variant CTLA-4 polypeptide contains the amino acid substitutions A26T/Y105L, G29W/Y105L, T53S/Y105L, L63P/Y105L, S72G/Y105L, L98Q/Y105L, M99L/Y105L or Y105L/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises an amino acid substitution in an unmodified or wild-type CTLA-4 polypeptide or specific binding fragment thereof corresponding to L106I. In some embodiments, the variant CTLA-4 polypeptide further contains one or more amino acid substitutions A26T, G29W, T53S, L63P, S72G, L98Q, M99L and/or Y105L. In some embodiments, the variant CTLA-4 polypeptide contains the amino acid substitutions A26T/L106I, G29W/L106I, T53S/L106I, L63P/L106I, S72G/L106I, L98Q/L106I, M99L/L1061 or Y105L/L106I. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 contains the amino acid substitutions E33V/M99L. The variant CTLA-4 polypeptide can include further amino acid modifications (e.g. substitutions), such as any described herein, in accord with provided embodiments. Table 2 sets forth exemplary amino acid modifications (e.g. substitutions) and variant CTLA-4 polypeptides as described.

In some embodiments, the variant CTLA-4 polypeptide comprises at least three amino acid modifications (e.g. substitutions), wherein the at least three modifications (e.g. substitutions) in an unmodified or wild-type CTLA-4 or specific binding fragment thereof corresponding to A26T, G29W, T53S, L63P, S72G, L98Q, M99L, Y105L and/or L1061 or a conservative amino acid substitution thereof, with reference to positions set forth in SEQ ID NO:2.

In some embodiments, the variant CTLA-4 polypeptide comprises amino acid substitutions in an unmodified or wild-type CTLA-4 or specific binding fragment thereof corresponding to G29W/L98Q/Y105L, with reference to positions set forth in SEQ ID NO:2.

In some embodiments, the variant CTLA-4 polypeptide comprises amino acid substitutions in an unmodified or wild-type CTLA-4 or specific binding fragment thereof corresponding to G29W/N58S/L63P/Q82R/L98Q/Y105L, with reference to positions set forth in SEQ ID NO:2.

In some embodiments, the variant CTLA-4 polypeptide comprises amino acid substitutions in an unmodified or wild-type CTLA-4 or specific binding fragment thereof corresponding to L12F/R16H/G29W/M56T/L98Q/Y105L, with reference to positions set forth in SEQ ID NO:2.

In some embodiments, wherein the variant CTLA-4 polypeptide has a single amino acid substitution in an unmodified CTLA-4 or specific binding fragment thereof, the modification does not correspond to position 27, 31, 32, 33, 35, 95, 98, 105, 106, or 107 with reference to positions set forth in SEQ ID NO:2. In some embodiments, wherein the variant CTLA-4 polypeptide has a single amino acid substitution in an unmodified CTLA-4 or specific binding fragment thereof, the modification is not L106E. In some embodiments, wherein the variant CTLA-4 polypeptide has exactly two amino acid substitutions in an unmodified CTLA-4 or specific binding fragment thereof, the modifications are not A31Y and L106E (i.e., A31Y/L106E).

In some embodiments, the variant CTLA-4 does not contain a modification corresponding to A26E, T32N, V34I, A52M, G57E, I67F, S66P and/or S72F, with reference to numbering set forth in SEQ ID NO:2. In some embodiments, wherein the variant CTLA-4 polypeptide has seven amino acid substitutions in an unmodified CTLA-4 or specific binding fragment thereof, the modifications are not modifications corresponding to T32N, V34I, A52M, M56K, G57E, S66P and S72F, with reference to numbering set forth in SEQ ID NO:2. In some embodiments, wherein the variant CTLA-4 polypeptide has ten amino acid substitutions in an unmodified CTLA-4 or specific binding fragment thereof, the modifications are not modifications corresponding to A26E, T32N, V34I, A52M, M56K, N58D, S66P, I67S, S72F and L106E, with reference to numbering set forth in SEQ ID NO:2.

In some embodiments, the variant CTLA-4 polypeptide has two or more amino acid modifications selected from among A6T, V10A, L12F, L12H, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, Y105F, Y105L, L106I, L106R, I108F, I108V, N110K, N110S, N110Y, Y115N, V116A, I117E, I117L, I117M, and I117T, with reference to numbering set forth in SEQ ID NO:2. In some embodiments, the two or more amino acid modifications are A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/

Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99L/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/S72G/L98Q/Y105L/P121S, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V/E59G/L63P/S72G/M87K/I93V/L98Q/M99L/Y105L/I117E, T61A/L63P/S72G/L98Q/M99L/Y105L, L63P/T69A/L98Q/M99L/Y105L/L106R/V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, S72G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, and L98R/N110K, with reference to numbering set forth in SEQ ID NO:2.

In some embodiments, the variant CTLA-4 polypeptide has two or more amino acid modifications selected from among A6T, V10A, L12F, L12H, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, Y105F, Y105L, L106I, L106R, I108F, I108V, N110K, N110S, N110Y, Y115N, V116A, I117E, I117L, I117M, I117T, E120D, C122P, D124P, D124I, S125I, D126P, and D126T, with reference to numbering set forth in SEQ ID NO:2. In some embodiments, the two or more amino acid modifications are A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/

M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99L/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/S72G/L98Q/Y105L/P121S, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V/E59G/L63P/S72G/M87K/I93V/L98Q/M99L/Y105L/I117E, T61A/L63P/S72G/L98Q/M99L/Y105L, L63P/T69A/L98Q/M99L/Y105L/L106R/V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, S72G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, L98R/N110K, T89A/L98Q/M99L/Y105L/L106I/Y115N/E120D/C122P/D124P/S125I/D126P, N58S/L63P/T71A/S72G/L98Q/M99L/Y105L/D1241/S125P/D126T, R16G/E33M/N58S/E59G/L63P/L98Q/Y105L/E120D/C122P/D124P/S125I/D126P, G29W/L63P/S72G/L98Q/Y105L/P121S/D126T, L12H/E33M/L98Q/Y105L, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/L98Q, T53S/M56K/N58S/L63P/M87V/Y105L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/Y105L, E33V/M99L/Y105L, E33V/L98Q/M99L, E33V/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L, M56T/L98Q/Y105L, L12F/R16H/G29W/M56T/S72G/L98Q/Y105L, and G29W/M56T/S72G/L98Q/Y105L with reference to numbering set forth in SEQ ID NO:2.

In some embodiments, the variant CTLA-4 polypeptide additionally includes the amino acid modification C122S with reference to positions set forth in SEQ ID NO:2 or 569.

In some embodiments, the variant CTLA-4 polypeptide comprises any of the substitutions (mutations) listed in Table 2. Table 2 also provides exemplary sequences by reference to SEQ ID NO for the extracellular domain (ECD) or IgV domain of wild-type CTLA-4 or exemplary variant CTLA-4 polypeptides. Table 2 also provides exemplary sequences of a variant CTLA-4 polypeptide attached to an immunoglobulin Fc (yielding an "immunomodulatory Fc fusion," such as a "CTLA-4-Fc variant fusion," also termed a CTLA-4 vIgD-Fc fusion). Such fusion polypeptides are further described below. As indicated, the exact locus or residues corresponding to a given domain can vary, such as depending on the methods used to identify or classify the domain. Also, in some cases, adjacent N- and/or C-terminal amino acids of a given domain (e.g., IgV) also can be included in a sequence of a variant IgSF polypeptide, such as to ensure proper folding of the domain when expressed. Thus, it is understood that the exemplification of the SEQ ID NOs in Table 2 is not to be construed as limiting. For example, the particular domain, such as the IgV domain, of a variant CTLA-4 polypeptide can be several amino acids longer or shorter, such as 1-10, e.g., 1, 2, 3, 4, 5, 6 or 7 amino acids longer or shorter, than the sequence of amino acids set forth in the respective SEQ ID NO.

In some embodiments, the variant CTLA-4 polypeptide comprises any of the mutations listed in Table 2. In some embodiments, the variant CTLA-4 polypeptide comprises any of the extracellular domain (ECD) sequences listed in Table 2 (i.e., any one of SEQ ID NOS: 4-97, 99-104, or 106-155). In some embodiments, the variant CTLA-4 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 2 (i.e., any one of SEQ ID NOS: 4-97, 99-104, or 106-155) and contains the amino acid modification(s) of the respective SEQ ID NO, e.g., substitution(s) not present in the wild-type or unmodified CTLA-4. In some embodiments, the variant CTLA-4 polypeptide comprises a specific binding fragment of any of the extracellular domain (ECD) sequences listed in Table 2 (i.e., any one of SEQ ID NOS: 4-97, 99-104, or 106-155) and contains one or more of the amino acid modification(s)

of the respective SEQ ID NO, e.g., substitution(s) not present in the wild-type or unmodified CTLA-4.

In some embodiments, the variant CTLA-4 polypeptide comprises any of the mutations listed in Table 2. In some embodiments, the variant CTLA-4 polypeptide comprises any of the extracellular domain (ECD) sequences listed in Table 2 (i.e., any one of SEQ ID NOS: 4-97, 99-104, 106-155, 570-602, or 636). In some embodiments, the variant CTLA-4 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 2 (i.e., any one of SEQ ID NOS: 4-97, 99-104, 106-155, 570-602 or 636) and contains the amino acid modification(s) of the respective SEQ ID NO, e.g., substitution(s) not present in the wild-type or unmodified CTLA-4. In some embodiments, the variant CTLA-4 polypeptide comprises a specific binding fragment of any of the extracellular domain (ECD) sequences listed in Table 2 (i.e., any one of SEQ ID NOS: 4-97, 99-104, 106-155, 570-602 or 636) and contains one or more of the amino acid modification(s) of the respective SEQ ID NO, e.g., substitution(s) not present in the wild-type or unmodified CTLA-4.

In some embodiments, the variant CTLA-4 polypeptide comprises any of the IgV sequences listed in Table 2 (i.e., any one of SEQ ID NOS: 156-285). In some embodiments, the variant CTLA-4 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 2 (i.e., any one of SEQ ID NOS: 156-285) and contains the amino acid modification(s) of the respective SEQ ID NO, e.g., substitution(s), not present in the wild-type or unmodified CTLA-4. In some embodiments, the variant CTLA-4 polypeptide comprises a specific binding fragment of any of the IgV sequences listed in Table 2 (i.e., any one of SEQ ID NOS: 156-285) and contains one or more of the amino acid modification(s) of the respective SEQ ID NO, e.g. substitution(s) not present in the wild-type or unmodified CTLA-4.

In some embodiments, the variant CTLA-4 polypeptide comprises any of the IgV sequences listed in Table 2 (i.e., any one of SEQ ID NOS: 156-285, 603-635 or 637). In some embodiments, the variant CTLA-4 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 2 (i.e., any one of SEQ ID NOS: 156-285, 603-635 or 637) and contains the amino acid modification(s) of the respective SEQ ID NO, e.g., substitution(s), not present in the wild-type or unmodified CTLA-4. In some embodiments, the variant CTLA-4 polypeptide comprises a specific binding fragment of any of the IgV sequences listed in Table 2 (i.e., any one of SEQ ID NOS: 156-285, 603-635 or 637) and contains the amino acid modification(s) of the respective SEQ ID NO, e.g. substitution(s) not present in the wild-type or unmodified CTLA-4.

TABLE 2

Exemplary variant CTLA-4 polypeptides

| Mutation(s) | ECD SEQ ID NO | IgV SEQ ID NO |
|---|---|---|
| Wild-type | 2,569 | 3 |
| L12P/A26T/L63P/L98Q/Y105L | 4 | 156 |
| L63P/L98R/N110K | 5 | 157 |
| L12P/A26T | 6 | 158 |
| L12P/A26T/L63P | 7 | 159 |
| L63P/L98Q/Y105L | 8 | 160 |
| L98Q/Y105L | 9 | 161 |
| L63P | 10 | 162 |
| L98R/N110K | 11 | 163 |
| L12P/A26T/L63P/L98Q/M99L/Y105L | 12 | 164 |
| E33M/Q82H/L98Q/M99L/Y105L | 13 | 165 |
| L63P/S72G/L98Q/M99L/Y105L | 14 | 166 |
| S14N/R16C/I18T/M56K/T61A/L63P/A86T/M99L | 15 | 167 |
| S27P/M56K/L63P/S72G/S73R/T89A/M99L/Y105L/I117M | 16 | 168 |
| M56K/L63P/N75D/V96I/M99L/Y105L/L106I | 17 | 169 |
| L63P/S72G/Y105L | 18 | 170 |
| L63P/L98Q/M99L/Y105L/I117M | 19 | 227 |
| L63P/S72G/L98Q/M99L/Y105L/L106I/I117L | 20 | 166 |
| A26T/L63P/S72G/L98Q/Y105L/L106I/I117L | 21 | 171 |
| L63P/L98Q/V116A | 22 | 205 |
| G29W/L98Q/M99L/Y105L | 23 | 172 |
| T37S/M56V/L98Q/Y105L | 24 | 173 |
| A26T/Y54F/M56K/M99L/Y105L | 25 | 174 |
| L12P/I18T/A26T/M55T/T69S/S72G/M99L/Y105L | 26 | 175 |
| V22I/L63P/L98Q/Y105L/I117M | 27 | 176 |
| A26T/L63P/S72G/L98Q/M99L/Y105L | 28 | 177 |
| E33M/A42T/L98Q/Y105L | 29 | 178 |
| M55T/E97Q/M99L/Y105F | 30 | 179 |
| M55T/S72G/L98Q/M99L/Y105L | 31 | 180 |
| R16C/G29W/E33V/M55T/L63P/L98Q/Y105L | 32 | 181 |
| L12P/A26T/L63P/L98Q/Y105L/L106I | 33 | 156 |
| M56L/L63P/L98Q/Y105L/L106I/I117L | 34 | 182 |
| S15P/I18V/M56T/L98Q/M99L/Y105L | 35 | 183 |
| I18T/G29W/L63P/L98Q/Y105L | 36 | 184 |

TABLE 2-continued

| Exemplary variant CTLA-4 polypeptides | | |
|---|---|---|
| Mutation(s) | ECD SEQ ID NO | IgV SEQ ID NO |
| L63P/Q82H/L98Q/M99L/Y105L | 37 | 185 |
| L98Q/M99L/Y105L/L106I/I117T | 38 | 206 |
| L98Q/M99L/Y105L/L106I/Y115N | 39 | 206 |
| M55T/L63P/T71I/M99L/Y105L | 40 | 186 |
| A26T/T53S/M56K/L63P/L98Q/Y105L | 41 | 187 |
| I18T/A26T/L63P/Q82R/L98Q/Y105L | 42 | 188 |
| L12H/M55T/E59D/L63P/M99L | 43 | 189 |
| I18T/L63P/S72G/L98Q/Y105L/I108V | 44 | 190 |
| I18T/L63P/S72G/L98Q/M99L/Y105L | 45 | 191 |
| T61A/L63P/S72G/L98Q/M99L/Y105L | 46 | 192 |
| V38I/L63P/S72G/L98Q/M99L/Y105L | 47 | 193 |
| L63P/S72G/I93L/L98Q/M99L/Y105L | 48 | 194 |
| L12H/M55T/M56V/I67T/M99L/L106R/I108F | 49 | 195 |
| I18N/A26T/L63H/T89A/L98Q/M99L/Y105L | 50 | 196 |
| I18T/E48R/L63P/T69S/L98Q/Y105L/N110Y | 51 | 197 |
| I18N/L63P/S72T/M87T/L98Q/Y105L/N110S | 52 | 198 |
| G29W/M56T/L63P/L98Q/Y105L/L106I/I117L | 53 | 199 |
| G29W/N58S/L63P/M87T/L98Q/M99L/Y105L | 54 | 200 |
| G29W/N58S/L63P/D64N/L98Q/M99L/Y105L | 55 | 201 |
| I18T/L63P/S72G/M87K/L98Q/M99L/Y105L | 56 | 202 |
| M56V | 57 | 203 |
| L63P/K95R | 58 | 204 |
| L63P/L98Q | 59 | 205 |
| L98Q/M99L/Y105L | 60 | 206 |
| L63P/M87K/M99L/L106R | 61 | 207 |
| L63P/M99L/Y105L/I108F | 62 | 208 |
| V10A/L63P/L98Q/Y105L | 63 | 209 |
| M56T/L91R/L98Q/Y105L | 64 | 210 |
| A26T/L63P/M87V/N1110K/I117E | 65 | 211 |
| G29W/L63P/L98Q/M99L/Y105L | 66 | 212 |
| A26T/V46E/L63P/D65G/L98Q | 67 | 213 |
| G29W/N58S/L63P/L98Q/Y105L | 68 | 214 |
| G29W/E59G/L63P/L98Q/Y105L | 69 | 215 |
| L12H/L63P/S72G/L98Q/Y105L | 70 | 216 |
| A6T/A26T/M55T/M99L/Y105L | 71 | 217 |
| A26T/L63P/D65G/L98Q/M99L/Y105L | 72 | 218 |
| V10A/L63P/D64V/S72G/L98Q/M99L/Y105L | 73 | 219 |
| L12P/G29W/D43N/N58S/L63P/L98Q/M99L/Y105L | 74 | 220 |
| I18V/A26T/L63P/D64E/L98Q/Y105L/L106R/N110K | 75 | 221 |
| A19V/G29W/R35K/L63P/L98Q/M99L/Y105L | 76 | 222 |
| L12P/A26T/L63P/S72G/T89M/L98Q/M99L/Y105L | 77 | 223 |
| P28L/E33V/L63P/S72G/L98R/M99L/Y105L | 78 | 224 |
| E24Q/L63P/S72G/L98Q/M99L/Y105L | 79 | 225 |
| I18T/G29R/L63P/S72G/L98Q/M99L/Y105L | 80 | 226 |
| L63P/L98Q/M99L/Y105L | 81 | 227 |
| Q41L/Y54F/M56K/M99L/I108F | 82 | 228 |
| S72G/L98Q/M99L/Y105L/I117T | 83 | 229 |
| M56R/L63P/L98Q/M99L/Y105L | 84 | 230 |
| E33M/L63P/S72G/L98Q/Y105L | 85 | 231 |
| L63P/L98Q/M99L/Y105L/L106I | 86 | 227 |
| A26T/M55R/L98Q/M99L/Y105L | 87 | 232 |
| L63P/S72G/M87A/L98Q/Y105L | 88 | 233 |
| A26D/S72G/L98Q/M99L/Y105L | 89 | 234 |
| V22A/L63P/L98Q/M99L/Y105L/P119H | 90 | 235 |
| A26T/M55T/L63P/L98Q/M99L/Y105L | 91 | 236 |
| E33V/A42S/M55T/L98Q/M99L/Y105L | 92 | 237 |
| G29W/N58S/L63P/Q82R/L98Q/Y105L | 93 | 238 |
| E33M/L63P/S72G/L98Q/Y105L/I117L | 94 | 231 |
| A26T/I67N/S72G/L98Q/M99L/Y105L | 95 | 239 |
| L12F/A26T/L63P/L98Q/Y105L/L106R | 96 | 240 |
| S20N/A26T/L63P/L98Q/M99L/Y105L | 97 | 241 |
| G29W/T61I/L63P/S72G/L98Q/M99L/Y105L | 99 | 243 |
| G29W/N58S/L63P/T69I/L98Q/M99L/Y105L | 100 | 244 |
| L12P/L63P/S72G/L98Q/M99L/Y105L/L106N | 101 | 245 |
| L63P/T69A/L98Q/M99L/Y105L/L106R/V116A | 102 | 246 |
| G29W/N58S/L63P/S72G/L98Q/Y105L | 103 | 247 |
| G29W/L63P/D65G/S72G/L98Q/Y105L | 104 | 248 |
| T53S/M56V/L98Q/Y105L | 106 | 249 |
| L63P/S72G/L98Q/Y105L | 107 | 250 |
| I18A/L63P/S72G/L98Q/Y105L | 108 | 251 |
| G29W/T53S/M56K/L63P/L98Q/Y105L | 109 | 252 |
| I18V/G29W/L63P/S72G/L98Q/Y105L | 110 | 253 |
| G29W/L63P/S72G/L98Q/Y105L/L106I | 111 | 254 |
| G29W/L63P/I67V/S72G/L98Q/Y105L | 112 | 255 |

TABLE 2-continued

Exemplary variant CTLA-4 polypeptides

| Mutation(s) | ECD SEQ ID NO | IgV SEQ ID NO |
|---|---|---|
| G29W/M55V/E59G/L63P/L98Q/Y105L | 113 | 256 |
| G29W/L63P/S72G/L98Q/Y105L/I117L | 114 | 254 |
| L63P/S72G/L98Q/Y105L/L106I/I117L | 115 | 250 |
| L12F/R16H/G29W/M56T/L98Q/Y105L | 116 | 257 |
| L12P/G29W/L63P/S72G/L98Q/Y105L | 117 | 258 |
| L12P/G29W/L63P/S72G/L98Q/Y105L/L106I | 118 | 258 |
| G29W/L63P/S72G/L98Q/Y105L/L106I/I117L | 119 | 254 |
| G29W/N58S/L63P/S72G/L98Q/Y105L/L106I | 120 | 247 |
| A26T/T53S/L63P/L98Q/Y105L/L106I/I117L | 121 | 259 |
| G29W/N58S/L63P/S72G/M87V/L98Q/Y105L | 122 | 260 |
| G29W/S72G/C176R/L98Q/Y105L/L106I/Q113H | 123 | 261 |
| G29W/N58S/L63P/S72G/L98Q/Y105L/L106V | 124 | 247 |
| A26T/L63P/L98Q/M99L/Y105L | 125 | 262 |
| G29W/N58D/I67V/L98Q/M99L/Y105L | 126 | 263 |
| I67V/S72G/Q82H/T89A/L98Q/M99L/Y105L | 127 | 264 |
| S72G/R85G/L98Q/M99L/Y105L/L106I | 128 | 265 |
| A26T/T47A/M56K/L63P/S72G/Q82R/L98Q/M99L/Y105L | 129 | 266 |
| A26T/M55T/L63P/S72G/L98Q/M99L/Y105L | 130 | 267 |
| L12H/I18V/A42T/M55T/N58D/L98R/Y105L/L106I/P121S | 131 | 268 |
| I18T/A26T/L63P/S72G/L98Q/Y105L | 132 | 269 |
| L12F/K30R/S72G/Q82R/L98Q/M99L/Y105L | 133 | 270 |
| L12P/L63P/S72G/L98Q/M99L/Y105L/L106N/I117L | 134 | 281 |
| G29W/M87K/I93V/L98Q/M99L/Y105L | 135 | 271 |
| P28L/E33V/L63P/S72G/L98Q/M99L/Y105L | 136 | 272 |
| G29W/T53S/M56K/L63P/Q82H/L98Q/M99I/Y105L | 137 | 273 |
| I18F/L63P/L98Q/M99L/Y105L/P121S | 138 | 274 |
| L63P/L98Q/M99L/Y105L/I108V | 139 | 227 |
| A26T/A42V/Q45H/I67N/M87K/E970/M99L | 140 | 275 |
| M56V/E59G/L63P/S72G/M87K/I93V/L98Q/M99L/Y105L/I117E | 141 | 276 |
| G29W/M87K/T89S/L98Q/M99L/Y105L/I108V/I117L | 142 | 242 |
| L12P/M56V/L63P/V96I/L98Q/M99L/Y105L/Y115H | 143 | 277 |
| G29W/T53S/M56K/T61N/L63P/L98Q/Y105L | 144 | 278 |
| I18T/A26S/M55T/M56V/L63P/S72G/L98Q/M99L/Y105L/I117K | 145 | 279 |
| I18T/T61R/L63P/S72G/L98Q/M99L/Y105L | 146 | 280 |
| L12P/L63P/S72G/L98Q/M99L/Y105L | 147 | 281 |
| E33M/L63P/S72G/L98Q/Y105L/I108F | 148 | 231 |
| L12P/R16H/A26T/T61S/L63P/M87V/L98Q/M99L/Y105L/L106I/I117L | 149 | 282 |
| G29W/T53S/M56K/N58S/L63P/M87V/L98Q/Y105L/P121S | 150 | 283 |
| G29W/L63P/S72G/L98Q/Y105L/P121S | 151 | 254 |
| G29W/T53S/M56K/N58S/L63P/M87V/L98Q/Y105L | 152 | 283 |
| G29W/T53S/M56K/N58S/L63P/M87V/L98Q/Y105L/I108V | 153 | 283 |
| G29W/T53S/L63P/S72G/L98Q/Y105L | 154 | 284 |
| V10A/G29W/T53S/M56K/L63P/L98Q/Y105L/P121S | 155 | 285 |
| T89A/L98Q/M99L/Y105L/L106I/Y115N/E120D/C122P/D124P/S125I/D126P | 570 | 603 |
| N58S/L63P/T71A/S72G/L98Q/M99L/Y105L/D124I/S125P/D126T | 571 | 604 |
| R16G/E33M/N58S/E59G/L63P/L98Q/Y105L/E120D/C122P/D124P/S125I/ D126P | 572 | 605 |
| G29W/L63P/S72G/L98Q/Y105L/P121S/D126T | 573 | 606 |
| L12H/E33M/L98Q/Y105L | 574 | 607 |
| T53S/M56K/N58S/L63P/M87V/L98Q/Y105L | 575 | 608 |
| I18T/A26T/M55T/M56K/L63P/L98Q/M99L/Y105L | 576 | 609 |
| I18T/A26T/M56K/L63P/L98Q/Y105L | 577 | 610 |
| T53S/L63P/L98Q | 578 | 611 |
| T53S/L63P/Y105L | 579 | 612 |
| T53S/M56K/N58S/L63P/M87V/L98Q | 580 | 613 |
| T53S/M56K/N58S/L63P/M87V/Y105L | 581 | 614 |
| T53S/M56K/N58S/L63P/L98Q/Y105L | 582 | 615 |
| T53S/M56K/N58S/M87V/L98Q/Y105L | 583 | 616 |
| T53S/M56K/L63P/M87V/L98Q/Y105L | 584 | 617 |
| T53S/N58S/L63P/M87V/L98Q/Y105L | 585 | 618 |
| M56K/N58S/L63P/M87V/L98Q/Y105L | 586 | 619 |
| E33V/L98Q/Y105L | 587 | 620 |
| E33V/M99L/Y105L | 588 | 621 |
| E33V/L98Q/M99L | 589 | 622 |
| E33V/M99L | 590 | 623 |
| L12F/R16H/G29W/M56T/L98Q | 591 | 624 |
| L12F/R16H/G29W/M56T/Y105L | 592 | 625 |
| L12F/R16H/G29W/L98Q/Y105L | 593 | 626 |
| L12F/R16H/M56T/L98Q/Y105L | 594 | 627 |
| G29W/M56T/L98Q/Y105L | 595 | 628 |
| L12F/G29W/L98Q/Y105L | 596 | 629 |
| L12F/L98Q/Y105L | 597 | 630 |
| R16H/L98Q/Y105L | 598 | 631 |
| G29W/L98Q/Y105L | 599 | 632 |

TABLE 2-continued

| Exemplary variant CTLA-4 polypeptides | | |
|---|---|---|
| Mutation(s) | ECD SEQ ID NO | IgV SEQ ID NO |
| M56T/L98Q/Y105L | 600 | 633 |
| L12F/R16H/G29W/M56T/S72G/L98Q/Y105L | 601 | 634 |
| G29W/M56T/S72G/L98Q/Y105L | 602 | 635 |
| I18T/T61R/L63P/S72G/L98Q/M99L/P102L/Y105L | 636 | 637 |

In some embodiments, the variant CTLA-4 polypeptide exhibits increased binding affinity for the ectodomain of CD80 compared to the wild-type or unmodified CTLA-4 polypeptide, such as comprising the sequence set forth in SEQ ID NO: 2 or 3. In some embodiments, the variant CTLA-4 polypeptide exhibits increased binding affinity for the ectodomain of CD86 compared to the wild-type or unmodified CTLA-4 polypeptide, such as comprising the sequence set forth in SEQ ID NO: 2 or 3. In some embodiments, the CTLA-4 polypeptide exhibits increased affinity for the ectodomain of CD80 and the ectodomain of CD86 compared to the wild-type or unmodified CTLA-4, such as comprising the sequence set forth in SEQ ID NO: 2 or 3.

In some embodiments, the variant CTLA-4 polypeptide exhibits increased affinity for the ectodomain of ICOSL compared to the wild-type or unmodified CTLA-4 polypeptide, such as comprising the sequence set forth in SEQ ID NO: 2 or 3. In some embodiments, the CTLA-4 polypeptide exhibits increased affinity for the ectodomain of ICOSL and the ectodomain of CD80 compared to the wild-type or unmodified CTLA-4, such as comprising the sequence set forth in SEQ ID NO: 2 or 3. In some embodiments, the CTLA-4 polypeptide exhibits increased affinity for the ectodomain of ICOSL and the ectodomain of CD86 compared to the wild-type or unmodified CTLA-4, such as comprising the sequence set forth in SEQ ID NO: 2 or 3.

In some embodiments, the CTLA-4 polypeptide exhibits increased affinity for the ectodomain of ICOSL, the ectodomain of CD80, and the ectodomain of CD86 compared to the wild-type or unmodified CTLA-4, such as comprising the sequence set forth in SEQ ID NO: 2 or 3.

In some embodiments, the variant CTLA-4 polypeptide exhibits increased binding affinity for binding the ectodomain of CD80 and exhibits decreased binding affinity for binding to the ectodomains of CD86 and/or ICOSL compared to the wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD80 and the ectodomain of CD86, and decreased affinity for the ectodomain of ICOSL, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD80 and the ectodomain of ICOSL, and decreased affinity for the ectodomain of CD86, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD80, and decreased affinity for the ectodomain of CD86 and the ectodomain of ICOSL, compared to wild-type or unmodified CTLA-4 polypeptide, such as comprising the sequence set forth in SEQ ID NO: 2 or 3.

In some embodiments, the variant CTLA-4 polypeptide exhibits increased binding affinity for binding the ectodomain of CD86 and exhibits decreased binding affinity for binding to the ectodomains of CD80 and/or ICOSL compared to the wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD86 and the ectodomain of CD80, and decreased affinity for the ectodomain of ICOSL, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD86 and the ectodomain of ICOSL, and decreased affinity for the ectodomain of CD80, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of CD86, and decreased affinity for the ectodomain of CD80 and the ectodomain of ICOSL, compared to wild-type or unmodified CTLA-4 polypeptide, such as comprising the sequence set forth in SEQ ID NO: 2 or 3.

In some embodiments, the variant CTLA-4 polypeptide exhibits increased binding affinity for binding the ectodomain of ICOSL and exhibits decreased binding affinity for binding to the ectodomains of CD80 and/or CD86 compared to the wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of ICOSL and the ectodomain of CD80, and decreased affinity for the ectodomain of CD86, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of ICOSL and the ectodomain of CD86, and decreased affinity for the ectodomain of CD80, compared to wild-type or unmodified CTLA-4 polypeptide, such as comprising the sequence set forth in SEQ ID NO: 2 or 3. In some embodiments, the variant CTLA-4 polypeptide exhibits increased affinity for the ectodomain of ICOSL, and decreased affinity for the ectodomain of CD80 and the ectodomain of CD86, compared to wild-type or unmodified CTLA-4 polypeptide, such as comprising the sequence set forth in SEQ ID NO: 2 or 3.

In some embodiments, the variant CTLA-4 polypeptide exhibits increased binding affinity for the ectodomain of CD80 compared to a wild-type or unmodified CTLA-4 polypeptide, such as a wild-type or unmodified CTLA-4 polypeptide, comprising the sequence set forth in SEQ ID NO:2 or 3. In some embodiments, the increased affinity to the ectodomain of CD80 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CTLA-4 for the ectodomain of CD80. In some of these embodiments, the variant CTLA-4 polypeptide that exhibits increased binding affinity for CD80 compared to a wild-type or unmodified CTLA-4 polypeptide has one or more amino acid substitutions V10A, L12F, R16H, I18T, A26T, G29W, E33V, A42V, Q45H, T53S, M55T, M56K, M56T, N58S, L63P, I67N, Q82R, M87K, M87V, E97Q, L98Q, M99L, Y105L, I108V and/or P121S in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for CD80 compared to a wild-type or unmodified CTLA-4 polypeptide has one or more amino acid substitutions I18T, A26T, G29W, E33V, A42V, Q45H, T53S, M56K, N58S, L63P, I67N, Q82R, M87K, M87V, E97Q, L98Q, M99L, Y105L and/or I108V in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for CD80 compared to a wild-type or unmodified CTLA-4 polypeptide has one or more amino acid substitutions I18T, A26T, G29W, A42V, Q45H, N58S, L63P, I67N, Q82R, M87K, M87V, L98Q and/or Y105L in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for CD80 compared to a wild-type or unmodified CTLA-4 polypeptide has one or more amino acid substitutions from among I18T, A26T, G29W, N58S, L63P, M87K, M87V, L98Q and/or Y105L in the extracellular domain or IgV domain thereof of an unmodified or wild-type CTLA-4, with reference to numbering of SEQ ID NO: 2. In some embodiments, the variant CTLA-4 polypeptide has at least 2, 3, 4 or 5 of such amino acid substitutions and exhibits increased binding to the ectodomain of CD80 compared to a wild-type or unmodified CTLA-4 polypeptide, such as a wild-type or unmodified CTLA-4 polypeptide, comprising the sequence set forth in SEQ ID NO:2 or 3. In some embodiments, the amino acid substitutions are I18T/G29W/L63P/L98Q/Y105L, G29W/N58S/L63P/L98Q/Y105L, G29W/N58S/L63P/Q82R/L98Q/Y105L, L12F/R16H/G29W/M56T/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, V10A/G29W/T53S/M56K/L63P/L98Q/Y105L/P121S, T53S/M56K/N58S/L63P/M87V/L98Q/Y105L, I18T/A26T/M55T/M56K/L63P/L98Q/M99L/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L or M56T/L98Q/Y105L. In some embodiments, the amino acid substitutions are I18T/G29W/L63P/L98Q/Y105L, G29W/N58S/L63P/L98Q/Y105L, G29W/N58S/L63P/Q82R/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, L98Q/M99L/Y105L, E33V/L98Q/Y105L, T53S/M56K/N58S/L63P/L98Q/Y105L, T53S/M56K/N58S/M87V/L98Q/Y105L or E33V/L98Q/M99L. In some embodiments, the amino acid substitutions are I18T/G29W/L63P/L98Q/Y105L, G29W/N58S/L63P/L98Q/Y105L, G29W/N58S/L63P/Q82R/L98Q/Y105L, A26T/A42V/Q45H/I67N/M87K/E97Q/M99L or T53S/M56K/N58S/M87V/L98Q/Y105L. In some embodiments, any of the above substitutions are in a CTLA-4 extracellular domain set forth in SEQ ID NO:2, e.g. see exemplary SEQ ID NOS set forth in Table 2. In some embodiments, any of the above substitutions are in a CTLA-4 extracellular domain set forth in SEQ ID NO:3, e.g. see exemplary SEQ ID NOS set forth in Table 2.

In some embodiments, the variant CTLA-4 polypeptide exhibits increased binding affinity for the ectodomain of CD86 compared to a wild-type or unmodified CTLA-4 polypeptide, such as a wild-type or unmodified CTLA-4 polypeptide, comprising the sequence set forth in SEQ ID NO:2 or 3. In some embodiments, the increased affinity to the ectodomain of CD86 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CTLA-4 for the ectodomain of CD86. In some of these embodiments, the variant CTLA-4 polypeptide that exhibits increased binding affinity for CD86 compared to a wild-type or unmodified CTLA-4 polypeptide has one or more amino acid substitutions L12F, L12H, L12P, R16H, I18T, I18V, S20N, A26T, G29R, G29W, E33M, E33V, A42S, A42V, T47A, T53S, M55T, M56K, M56R, M56T, M56V, N58D, N58S, T61I, T61N, T61R, T61S, L63P, D65G, I67N, I67V, T69A, T69I, S72G, Q76R, Q82H, Q82R, R85G, M87K, M87V, T89A, T89M, T89S, V961, L98Q, L98R, M99L, P102L, Y105L, L106I, L106N, L106R, L106V, I108F, I108V, Q113H, Y115H, V116A, I117L, I117T and/or P121S in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for CD86 compared to a wild-type or unmodified CTLA-4 polypeptide has one or more amino acid substitutions L12P, A26T, M55T, L63P, S72G, L98Q, M99L and/or Y105L in the extracellular domain or IgV domain thereof of an unmodified or wild-type CTLA-4, with reference to numbering of SEQ ID NO: 2. In some embodiments, the variant CTLA-4 polypeptide has at least 2, 3, 4 or 5 of such amino acid substitutions and exhibits increased binding to the ectodomain of CD86 compared to a wild-type or unmodified CTLA-4 polypeptide, such as a wild-type or unmodified CTLA-4 polypeptide, comprising the sequence set forth in SEQ ID NO:2 or 3. In some embodiments, the amino acid substitutions are I18T/T61R/L63P/S72G/L98Q/M99L/P102L/Y105L, L12P/A26T/L63P/S72G/T89M/L98Q/M99L/Y105L, I18T/G29R/L63P/S72G/L98Q/M99L/Y105L, S72G/L98Q/M99L/Y105L/I117T, M56R/L63P/L98Q/M99L/Y105L, L63P/L98Q/M99L/Y105L/L106I, A26T/M55T/L63P/L98Q/M99L/Y105L, E33V/A42S/M55T/L98Q/M99L/Y105L, G29W/N58S/L63P/Q82R/L98Q/Y105L, E33M/L63P/S72G/L98Q/Y105L/I117L, A26T/I67N/S72G/L98Q/M99L/Y105L, L12F/A26T/L63P/L98Q/Y105L/L106R, S20N/A26T/L63P/L98Q/M99L/Y105L, G29W/T61I/L63P/S72G/L98Q/M99L/Y105L, G29W/N58S/L63P/T69I/L98Q/M99L/Y105L, L12P/L63P/

S72G/L98Q/M99L/Y105L/L106N, L63P/T69A/L98Q/M99L/Y105L/L106R/V116A, G29W/N58S/L63P/S72G/L98Q/Y105L, G29W/L63P/D65G/S72G/L98Q/Y105L, T53S/M56V/L98Q/Y105L, L63P/S72G/L98Q/Y105L, G29W/L63P/S72G/L98Q/Y105L/L106I, L12F/R16H/G29W/M56T/L98Q/Y105L, G29W/N58S/L63P/S72G/M87V/L98Q/Y105L, G29W/S72G/Q76R/L98Q/Y105L/L106I/Q113H, G29W/N58S/L63P/S72G/L98Q/Y105L/L106V, G29W/N58D/I67V/L98Q/M99L/Y105L, I67V/S72G/Q82H/T89A/L98Q/M99L/Y105L, S72G/R85G/L98Q/M99L/Y105L/L106I, L63P/L98Q/M99L/Y105L, A26T/T47A/M56K/L63P/S72G/Q82R/L98Q/M99L/Y105L, A26T/M55T/L63P/S72G/L98Q/M99L/Y105L, L12H/I18V/A42T/M55T/N58D/L98R/Y105L/L106I/P121S, E33M/L63P/S72G/L98Q/Y105L, G29W/M87K/T89S/L98Q/M99L/Y105L/I108V/I117L, L12P/M56V/L63P/V96I/L98Q/M99L/Y105L/Y115H, G29W/T53S/M56K/T61N/L63P/L98Q/Y105L, I18T/T61R/L63P/S72G/L98Q/M99L/Y105L, L12P/L63P/S72G/L98Q/M99L/Y105L, E33M/L63P/S72G/L98Q/Y105L/I108F, L12P/R16H/A26T/T61S/L63P/M87V/L98Q/M99L/Y105L/L106I/I117L, L98Q/M99L/Y105L, T53S/M56K/N58S/M87V/L98Q/Y105L, L12F/R16H/G29W/M56T/L98Q, L12F/G29W/L98Q/Y105L or L12F/L98Q/Y105L. In some embodiments, the amino acid substitutions are A26T/M55T/L63P/S72G/L98Q/M99L/Y105L or L12P/L63P/S72G/L98Q/M99L/Y105L. In some embodiments, any of the above substitutions are in a CTLA-4 extracellular domain set forth in SEQ ID NO:2, e.g. see exemplary SEQ ID NOS set forth in Table 2. In some embodiments, any of the above substitutions are in a CTLA-4 extracellular domain set forth in SEQ ID NO:3, e.g. see exemplary SEQ ID NOS set forth in Table 2.

In some embodiments, the variant CTLA-4 polypeptide exhibits increased binding affinity for the ectodomain of ICOSL compared to a wild-type or unmodified CTLA-4 polypeptide, such as a wild-type or unmodified CTLA-4 polypeptide, comprising the sequence set forth in SEQ ID NO:2 or 3. In some embodiments, the increased affinity to the ectodomain of ICOSL is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CTLA-4 for the ectodomain of ICOSL. In some of these embodiments, the variant CTLA-4 polypeptide that exhibits increased binding affinity for ICOSL compared to a wild-type or unmodified CTLA-4 polypeptide has one or more amino acid substitutions V10A, L12F, L12I, R16H, I18N, I18T, I18V, A19V, A26T, G29W, E33M, E33V, R35K, V38I, A42V, Q45H, T47A, T53S, M55T, M56K, M56V, N58D, N58S, T61A, T61R, L63H, L63P, D64E, D64N, D64V, D65G, I67N, I67T, I67V, T69I, S72G, Q76R, Q82H, Q82R, R85G, M87K, M87T, M87V, T89A, T89S, I93L, I93V, E97Q, L98Q, M99L, M991, Y105L, L106I, L106R, I108F, I108V, N110K, Q113H, I117L and/or P121S in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for ICOSL compared to a wild-type or unmodified CTLA-4 polypeptide has one or more amino acid substitutions V10A, L12F, R16H, I18T, I18V, A19V, A26T, G29W, E33V, R35K, A42V, Q45H, T47A, T53S, M55T, M56K, M56T, N58D, N58S, L63P, D64E, D64V, I67N, I67V, S72G, Q82H, Q82R, R85G, M87K, M87T, M87V, T89A, T89S, I93V, E97Q, L98Q, M99L, Y105L, L106I, L106R, I108F, I108V, N100K and/or I117L in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for ICOSL compared to a wild-type or unmodified CTLA-4 polypeptide has one or more amino acid substitutions L12F, I18T, I18V, A26T, G29W, E33V, A42V, Q45H, T53S, M55T, M56K, N58D, N58S, L63P, D64E, I67N, I67V, S72G, Q82H, R85G, M87K, M87V, T89A, T89S, I93V, E97Q, L98Q, M991, M99L, Y105L, L106I, L106R, I108F, I108V, N110K and/or N117L in the extracellular domain or IgV domain thereof of an unmodified or wild-type CTLA-4, with reference to numbering of SEQ ID NO: 2. In some of these embodiments, the variant CTLA-4 polypeptide that exhibits increased binding affinity for ICOSL compared to a wild-type or unmodified CTLA-4 polypeptide has one or more amino acid substitutions I18T, A26T, G29W, T53S, M55T, M56K, N58S, L63P, S72G, L98Q, M99L, Y105L, L106I, and/or N117L in the extracellular domain or IgV domain thereof of an unmodified or wild-type CTLA-4, with reference to numbering of SEQ ID NO: 2. In some embodiments, the variant CTLA-4 polypeptide has at least 2, 3, 4 or 5 of such amino acid substitutions and exhibits increased binding to the ectodomain of ICOSL compared to a wild-type or unmodified CTLA-4 polypeptide, such as a wild-type or unmodified CTLA-4 polypeptide, comprising the sequence set forth in SEQ ID NO:2 or 3. In some embodiments, the amino acid substitutions are L63P/S72G/L98Q/M99L/Y105L/L106I/I117L, G29W/L98Q/M99L/Y105L, M55T/S72G/L98Q/M99L/Y105L, L63P/Q82H/L98Q/M99L/Y105L, I18T/L63P/S72G/L98Q/M99L/Y105L, T61A/L63P/S72G/L98Q/M99L/Y105L, V38I/L63P/S72G/L98Q/M99L/Y105L, L63P/S72G/I93L/L98Q/M99L/Y105L, L12I/M55T/M56V/I67T/M99L/L106R/I108F, I18N/A26T/L63H/T89A/L98Q/M99L/Y105L, G29W/N58S/L63P/M87T/L98Q/M99L/Y105L, G29W/N58S/L63P/D64N/L98Q/M99L/Y105L, I18T/L63P/S72G/M87K/L98Q/M99L/Y105L, L63P/M87K/M99L/L106R, L63P/M99L/Y105L/I108F, G29W/L63P/L98Q/M99L/Y105L, A26T/L63P/D65G/L98Q/M99L/Y105L, V10A/L63P/D64V/S72G/L98Q/M99L/Y105L, I18V/A26T/L63P/D64E/L98Q/Y105L/L106R/N110K, A19V/G29W/R35K/L63P/L98Q/M99L/Y105L, G29W/N58S/L63P/T69I/L98Q/M99L/Y105L, G29W/T53S/M56K/L63P/L98Q/Y105L, L12F/R16H/G29W/M56T/L98Q/Y105L, A26T/T53S/L63P/L98Q/Y105L/L106I/I117L, G29W/S72G/Q76R/L98Q/Y105L/L106I/Q113H, G29W/N58D/I67V/L98Q/M99L/Y105L, I67V/S72G/Q82H/T89A/L98Q/M99L/Y105L, S72G/R85G/L98Q/M99L/Y105L/L106I, A26T/T47A/M56K/L63P/S72G/Q82R/L98Q/M99L/Y105L, A26T/M55T/L63P/S72G/L98Q/M99L/Y105L, G29W/M87K/I93V/L98Q/M99L/Y105L, G29W/T53S/M56K/L63P/Q82H/L98Q/M99L/Y105L, L63P/L98Q/M99L/Y105L/I108V, A26T/A42V/Q45H/I67N/M87K/E97Q/M99L, E33M/L63P/S72G/L98Q/Y105L, G29W/M87K/T89S/L98Q/M99L/Y105L/I108V/I117L, I18T/T61R/L63P/S72G/L98Q/M99L/Y105L, E33M/L63P/S72G/L98Q/Y105L/I108F, G29W/T53S/M56K/N58S/L63P/M87V/L98Q/Y105L/P121S, G29W/T53S/M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/M87V/L98Q, T53S/M56K/N58S/L63P/L98Q/Y105L, T53S/M56K/N58S/M87V/L98Q/Y105L, T53S/M56K/L63P/M87V/L98Q/Y105L, T53S/

N58S/L63P/M87V/L98Q/Y105L, M56K/N58S/L63P/M87V/L98Q/Y105L, E33V/L98Q/M99L, L12F/R16H/G29W/M56T/Y105L or L12F/L98Q/Y105L. In some embodiments, the amino acid substitutions are G29W/L98Q/M99L/Y105L, L63P/M99L/Y105L/I108F, I18V/A26T/L63P/D64E/L98Q/Y105L/L106R/N110K, G29W/N58D/I67V/L98Q/M99L/Y105L, I67V/S72G/Q82H/T89A/L98Q/M99L/Y105L, S72G/R85G/L98Q/M99L/Y105L/L106I, G29W/M87K/I93V/L98Q/M99L/Y105L, G29W/T53S/M56K/L63P/Q82H/L98Q/M99L/Y105L, A26T/A42V/Q45H/I67N/M87K/E97Q/M99L, G29W/M87K/T89S/L98Q/M99L/Y105L/I108V/I117L, G29W/T53S/M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L or L12F/L98Q/Y105L. In some embodiments, any of the above substitutions are in a CTLA-4 extracellular domain set forth in SEQ ID NO:2, e.g. see exemplary SEQ ID NOS set forth in Table 2. In some embodiments, any of the above substitutions are in a CTLA-4 extracellular domain set forth in SEQ ID NO:3, e.g. see exemplary SEQ ID NOS set forth in Table 2.

In some embodiments, provided variant CTLA-4 polypeptides containing an extracellular domain that has at least one affinity-modified IgSF domain (e.g., IgV) or a specific binding fragment thereof, relative to an IgSF domain contained in a wild-type or unmodified CTLA-4 polypeptide, exhibit altered signaling (e.g. decreases/inhibits signaling) by a stimulatory receptor capable of being engaged by one or more binding partner(s) of CTLA-4, such as CD80, CD86 and/or ICOSL, compared to a wild-type or unmodified CTLA-4 polypeptide upon binding the one or more binding partner(s). In some aspects, the stimulatory receptor is CD28 or ICOS, which, in some aspects is expressed on the surface of a T-cell and is capable of releasing cytokine in response to intracellular signal. In some embodiments, the altered signaling differs from that effected by a wild-type or unmodified CTLA-4 polypeptide control sequence, in the same format (e.g. Fc fusion protein), as determined by, for example, an assay that measures cytokine release (e.g., IL-2 release or IFN-gamma), following incubation with the specified variant and/or wild-type or unmodified CTLA-4 polypeptide. Exemplary assays are described in Examples. In some cases, an assay is a cell-based assay, such as a mixed lymphocyte reaction, in which the resulting read-out or function is the sum of the signaling activities of the functional binding partners expressed on the surface of cells in the assay. As discussed elsewhere herein, in some embodiments, the format of the provided variant CTLA-4 polypeptides can impact the type of activity, e.g. agonist or antagonist. In some embodiments, the variant CTLA-4 polypeptide is a fusion protein of the extracellular domain or a specific binding fragment thereof containing the IgV domain and a multimerization domain, such as an Fc domain, and the altered signaling is due to antagonist activity to block activity of the stimulatory receptor. In other aspects, the format may result in increased or agonist activity of the stimulatory receptor.

III. FORMAT OF VARIANT POLYPEPTIDES

The immunomodulatory polypeptide comprising a variant CTLA-4 provided herein can be formatted in a variety of ways, including as a soluble protein, membrane bound protein or secreted protein. In some embodiments, the particular format can be chosen for the desired therapeutic application. In some cases, an immunomodulatory polypeptide comprising a variant CTLA-4 polypeptide is provided in a format to antagonize or block activity of CD28 and/or ICOS by binding its binding partner (e.g., ICOSL, CD80 and/or CD86), thereby preventing CD28 and/or ICOS costimulatory signaling. In some embodiments, antagonism of CD28 and/or ICOSL may be useful to inhibit or suppress immunity, for example in autoimmunology. In some embodiments, antagonism of CD28 and/or ICOSL may be useful for treating inflammation or autoimmunity. In some cases, an immunomodulatory polypeptide comprising a variant CTLA-4 polypeptide is expressed on a cell as a switch receptor in which the CTLA-4 inhibitory receptor is turned into an activating receptor (e.g., with an ITAM signaling domain) and/or is expressed on a cell as a decoy receptor without an intracellular signaling domain. In some embodiments, a CTLA-4 activating receptor or decoy receptor may be useful for treating cancer. A skilled artisan can readily determine the activity of a particular format, such as for antagonizing, competing and/or blocking one or more specific binding partner or activating one or more downstream signaling pathway. Exemplary methods for assessing such activities are provided herein, including in the examples.

In some aspects, provided are immunomodulatory proteins comprising a vIgD of CTLA-4 in which such proteins are soluble, e.g., fused to an Fc chain. In some aspects, one or more additional IgSF domain, such as one or more additional vIgD, may be linked to a vIgD of CTLA-4 as provided herein (hereinafter called a “stack” or “stacked” immunomodulatory protein). In some embodiments, the modular format of the provided immunomodulatory proteins provides flexibility for engineering or generating immunomodulatory proteins for modulating activity of multiple counterstructures (multiple cognate binding partners). In some embodiments, such “stack” molecules can be provided in a soluble format or, in some cases, may be provided as membrane bound or secreted proteins. In some embodiments, a variant CTLA-4 immunomodulatory protein is provided as a conjugate in which is contained a vIgD of CTLA-4 linked, directly or indirectly, to a targeting agent or moiety, e.g., to an antibody or other binding molecules that specifically binds to a ligand, e.g., an antigen, for example, for targeting or localizing the vIgD to a specific environment or cell, such as when administered to a subject. In some embodiments, the targeting agent, e.g., antibody or other binding molecule, binds to an antigen on the surface of a leukocyte, lymphocyte, or lymphatic tissue, such as the spleen, spleen, tonsils, lymph vessels, lymph nodes, adenoids, and liver, thereby localizing the variant CTLA-4 containing the vIgD to the immune system, for example, to modulate activity of leukocytes or lymphocytes within the immune system.

In some embodiments, provided immunomodulatory proteins are expressed in or on cells and provided as part of an engineered cellular therapy (ECT). In some embodiments, the variant CTLA-4 polypeptide is expressed on a cell, such as an immune cell (e.g., T cell or antigen presenting cell), in membrane-bound form, thereby providing a transmembrane immunomodulatory protein (hereinafter also called a “TIP”). In some aspects, the variant CTLA-4 polypeptide is expressed in a cell, such as an immune cell (e.g., T cell or antigen presenting cell), in secretable form to thereby produce a secreted or soluble form of the variant CTLA-4 polypeptide (hereinafter also called a “SIP”), such as when the cells are administered to a subject. In some aspects, a SIP can antagonize a binding partner in the environment (e.g., immune microenvironment) in which it is secreted. In some embodiments, a variant CTLA-4 polypeptide is expressed in an infectious agent (e.g., viral or bacterial agent) which, upon administration to a subject, is able to infect a cell in vivo, such as an immune cell (e.g., T cell or antigen presenting cell), for delivery or expression of the variant polypeptide as a TIP or a SIP in the cell.

In some embodiments, a soluble immunomodulatory polypeptide, such as a variant CTLA-4 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant CTLA-4 sequence is deglycosylated. In even more specific embodiments, the IgV domain or ECD of the variant CTLA-4 is deglycosylated.

Non-limiting examples of provided formats are described in FIG. 1 and further described below.

A. Soluble Protein

In some embodiments, the immunomodulatory protein containing a variant CTLA-4 polypeptide is a soluble protein. Those of skill will appreciate that cell surface proteins typically have an intracellular domain, a transmembrane domain, and extracellular domain (ECD), and that a soluble form of such proteins can be made using the extracellular domain or an immunologically active subsequence thereof. Thus, in some embodiments, the immunomodulatory protein containing a variant CTLA-4 polypeptide lacks a transmembrane domain or a portion of the transmembrane domain. In some embodiments, the immunomodulatory protein containing a variant CTLA-4 lacks the intracellular (cytoplasmic) domain or a portion of the intracellular domain. In some embodiments, the immunomodulatory protein containing the variant CTLA-4 polypeptide only contains the vIgD portion containing the ECD domain or a portion thereof containing an IgV domain, or domains or specific binding fragments thereof containing the amino acid modification(s). In some aspects, such soluble polypeptides can be used to block and/or antagonize the activity of CD28 and ICOS, thereby inhibiting or attenuating an immune response. In some embodiments, a soluble variant CTLA-4 immunomodulatory protein (e.g. variant CTLA-4-Fc) as provided can be used in methods for treating autoimmunity or inflammatory indications.

In some embodiments, an immunomodulatory polypeptide comprising a variant CTLA-4 can include one or more variant CTLA-4 polypeptides of the invention. In some embodiments a polypeptide of the invention will comprise exactly 1, 2, 3, 4, or 5 variant CTLA-4 sequences. In some embodiments, at least two of the variant CTLA-4 sequences are identical variant CTLA-4 sequences.

In some embodiments, the provided immunomodulatory polypeptide comprises two or more vIgD sequences of CTLA-4. Multiple variant CTLA-4 polypeptides within the polypeptide chain can be identical (i.e., the same species) to each other or be non-identical (i.e., different species) variant CTLA-4 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g., a homodimer) or of non-identical species of polypeptides (e.g., a heterodimer). A composition having a plurality of linked polypeptides of the invention can, as noted above, have one or more identical or non-identical variant CTLA-4 polypeptides of the invention in each polypeptide chain.

In some embodiments, the immunomodulatory protein comprises a variant CTLA-4 polypeptide attached to an immunoglobulin Fc (yielding an "immunomodulatory Fc fusion," such as a "CTLA-4-Fc variant fusion," also termed a CTLA-4 vIgD-Fc fusion). In some embodiments, the attachment of the variant CTLA-4 polypeptide is at the N-terminus of the Fc. In some embodiments, the attachment of the variant CTLA-4 polypeptide is at the C-terminus of the Fc. In some embodiments, two or more CTLA-4 variant polypeptides (the same or different) are independently attached at the N-terminus and at the C-terminus.

In some embodiments, the Fc is murine or human Fc. In some embodiments, the Fc is a mammalian or human IgG1, IgG2, IgG3, or IgG4 Fc regions. In some embodiments, the Fc is derived from IgG1, such as human IgG1. In some embodiments, the Fc comprises the amino acid sequence set forth in SEQ ID NO: 533 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 533.

In some embodiments, the Fc region contains one more modifications to alter (e.g., reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of a CTLA-4-Fc variant fusion provided herein, thereby generating an Fc region variant. In some embodiments, the Fc region variant has decreased effector function. There are many examples of changes or mutations to Fc sequences that can alter effector function. For example, WO 2000/042072, WO2006/019447, WO2012/125850, WO2015/107026, US2016/0017041, and Shields et al., *J. Biol. Chem.,* 276(9): 6591-6604 (2001) describe exemplary Fc variants with improved or diminished binding to FcRs. The contents of those publications are specifically incorporated herein by reference.

In some embodiments, the provided variant CTLA-4-Fc fusions comprise an Fc region that exhibits reduced effector functions, which makes it a desirable candidate for applications in which the half-life of the CTLA-4-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the CTLA-4-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII FcR expression on hematopoietic cells is summarized in Table 3 on page 464 of Ravetch and Kinet, *Annu. Rev. Immunol.,* 9:457-492 (1991).

Non-limiting examples of in vitro assays to assess ADCC activity of a molecule of interest is described in U.S. Pat. No. 5,500,362 (see, e.g. Hellstrom et al., *Proc. Natl. Acad. Sci. USA,* 83(18):7059-7063 (1986)) and Hellstrom et al., *Proc. Natl. Acad. Sci. USA,* 82(5):1499-1502 (1985); U.S. Pat. No. 5,821,337 (see Bruggemann et al., *J. Exp. Med.* 166(5): 1351-1361 (1987)). Alternatively, non-radioactive assay methods may be employed (see, for example, ACTI™ non-radioactive cytotoxicity assay for flow cytometry (CellTechnology, Inc. Mountain View, Calif.); and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al., *Proc. Natl. Acad. Sci. USA,* 95(2):652-656 (1998).

C1q binding assays may also be carried out to confirm that the CTLA-4-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods,* 202:163 (1997); Cragg et al., *Blood,* 101(3): 1045-1052 (2003); and Cragg and Glennie, *Blood,* 103(7): 2738-2743 (2004)). FcRn binding and in vivo clearance/half-life determinations can also be performed using methods known in the art (see, e.g., Petkova et al., *Int. Immunol.,* 18(12):1759-1769 (2006)).

CTLA-4-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of CTLA-4-Fc variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Stohl, *Curr. Opin. Biotechnol.,* 20(6):685-691 (2009); alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.,* 276(9):6591-6604 (2001)).

In some embodiments, there is provided a CTLA-4-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a CTLA-4-Fc variant fusion comprises one or more amino acid substitution E356D and M358L, by EU numbering. In some embodiments, the Fc region of a CTLA-4-Fc variant fusion comprises one or more amino acid substitutions C220S, C226S, and/or C229S, by EU numbering. In some embodiments, the Fc region of a CTLA-4 variant fusion comprises one or more amino acid substitutions R292C and V302C, by EU numbering. See also Duncan & Winter, *Nature,* 332 (6166):738-40 (1988); U.S. Pat. Nos. 5,648,260; 5,624,821; and WO 94/29351 concerning other examples of Fc region variants.

In some embodiments, the wild-type IgG1 Fc can be the Fc set forth in SEQ ID NO: 533 having an allotype containing residues Glu (E) and Met (M) at positions 356 and 358 by EU numbering (e.g., f allotype). In other embodiments, the wild-type IgG1 Fc contains amino acids of the human G1m1 allotype, such as residues containing Asp (D) and Leu (L) at positions 356 and 358, e.g. as set forth in SEQ ID NO: 638. Thus, in some cases, an Fc provided herein can contain amino acid substitutions E356D and M358L to reconstitute residues of allotype G1 ml (e.g., alpha allotype). In some aspects, a wild-type Fc is modified by one or more amino acid substitutions to reduce effector activity or to render the Fc inert for Fc effector function. Exemplary effectorless or inert mutations include those described herein. Among effectorless mutations that can be included in an Fc of contructs provided herein are L234A, L235E and G237A by EU numbering. In some embodiments, a wild-type Fc is further modified by the removal of one or more cysteine residue, such as by replacement of the cysteine residues to a serine residue at position 220 (C220S) by EU numbering. Exemplary inert Fc regions having reduced effector function are set forth in SEQ ID NO: 526 and SEQ ID NO: 438 or 439, which are based on allotypes set forth in SEQ ID NO: 533 or SEQ ID NO: 638, respectively. In some embodiments, an Fc region used in a construct provided herein can further lack a C-terminal lysine residue.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.,* 164(8):4178-4184 (2000).

In some embodiments, there is provided a CTLA-4-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 533. In some embodiments, the Fc contains at least one amino acid substitution that is N82G by numbering of SEQ ID NO: 533

(corresponding to N297G by EU numbering). In some embodiments, the Fc further contains at least one amino acid substitution that is R77C or V87C by numbering of SEQ ID NO: 533 (corresponding to R292C or V302C by EU numbering). In some embodiments, the variant Fc region further comprises a C5S amino acid modification by numbering of SEQ ID NO: 533 (corresponding to C220S by EU numbering). For example, in some embodiments, the variant Fc region comprises the following amino acid modifications:

V297G and one or more of the following amino acid modifications C220S, R292C or V302C by EU numbering (corresponding to N82G and one or more of the following amino acid modifications C5S, R77C or V87C with reference to SEQ ID NO: 533), e.g., the Fc region comprises the sequence set forth in SEQ ID NO: 440. In some embodiments, the variant Fc region comprises one or more of the amino acid modifications C220S, L234A, L235E or G237A, e.g. the Fc region comprises the sequence set forth in SEQ ID NO: 441. In some embodiments, the variant Fc region comprises one or more of the amino acid modifications C220S, L235P, L234V, L235A, G236del or S267K, e.g., the Fc region comprises the sequence set forth in SEQ ID NO: 442. In some embodiments, the variant Fc comprises one or more of the amino acid modifications C220S, L234A, L235E, G237A, E356D or M358L, e.g., the Fc region comprises the sequence set forth in SEQ ID NO: 439.

In some embodiments, the Fc region lacks the C-terminal lysine corresponding to position 232 of the wild-type or unmodified Fc set forth in SEQ ID NO: 533 (corresponding to K447del by EU numbering). In some aspects, such an Fc region can additionally include one or more additional modifications, e.g. amino acid substitutions, such as any as described. An example of such an Fc region is set forth in SEQ ID NO: 438, 526, 527 or 528.

In some embodiments, there is provided a CTLA-4-Fc variant fusion comprising a variant Fc region in which the variant Fc comprises the sequence of amino acids set forth in any of SEQ ID NOS: 438-442 or 526-528 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 438-442 or 526-528.

In some embodiments, the Fc is derived from IgG2, such as human IgG2. In some embodiments, the Fc comprises the amino acid sequence set forth in SEQ ID NO: 529 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 529.

In some embodiments, the Fc comprises the amino acid sequence of human IgG4 set forth in SEQ ID NO: 530 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:530. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see, e.g., U.S. Pat. No. 8,911,726). In some embodiments, the Fc is an IgG4 containing the S228P mutation, which has been shown to prevent recombination between a therapeutic antibody and an endogenous IgG4 by Fab-arm exchange (see, e.g., Labrijin et al. (2009), *Nat. Biotechnol.,* 27(8)767-71.) In some embodiments, the Fc comprises the amino acid sequence set forth in human IgG4 with S228P set forth in SEQ ID NO: 531 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:531.

In some embodiments, the variant CTLA-4 polypeptide is directly linked to the Fc sequence. In some embodiments, the variant CTLA-4 polypeptide is indirectly linked to the Fc sequence, such as via a linker. In some embodiments, one or more "peptide linkers" link the variant CTLA-4 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is three alanines (AAA). In some embodiments, the linker is (in one-letter amino acid code): GGGGS ("4GS"; SEQ ID NO:535) or multimers of the 4GS linker, such as repeats of 2, 3, 4, or 5 4GS linkers, such as set forth in SEQ ID NO: 537 (2×GGGGS) or SEQ ID NO: 536 (3×GGGGS). In some embodiments, the linker (in one-letter amino acid code) is GSGGGGS (SEQ ID NO:534). In some embodiments, the linker is a 2×GGGGS followed by three alanines (GGGGSGGGGSAAA; SEQ ID NO:538).

In some embodiments, the variant CTLA-4 polypeptide comprises any of the CTLA-4-Fc sequences set forth in SEQ ID NOs: 286-379, 381-386, or 388-437. In some embodiments, the variant CTLA-4 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the CTLA-4-Fc sequences set forth in SEQ ID NOS: 286-379, 381-386, or 388-437 and contains the amino acid modification(s), e.g., substitution(s), not present in the wild-type or unmodified CTLA-4. In some embodiments, the variant CTLA-4 polypeptide comprises a specific binding fragment of any of the CTLA-Fc sequences set forth in SEQ ID NOS: 286-379, 381-386, or 388-437 and contains the amino acid modification(s), e.g. substitution(s) not present in the wild-type or unmodified CTLA-4.

In some embodiments, the variant CTLA-4-Fc fusion protein is a dimer formed by two variant CTLA-4 Fc polypeptides linked to an Fc domain. In some embodiments, the dimer is a homodimer in which the two variant CTLA-4 Fc polypeptides are the same. In some embodiments, the dimer is a heterodimer in which the two variant CTLA-4 Fc polypeptides are different.

Also provided are nucleic acid molecules encoding the variant CTLA-4-Fc fusion protein. In some embodiments, for production of an Fc fusion protein, a nucleic acid molecule encoding a variant CTLA-4-Fc fusion protein is inserted into an appropriate expression vector. The resulting variant CTLA-4-Fc fusion protein can be expressed in host cells transformed with the expression where assembly between Fc domains occurs by interchain disulfide bonds formed between the Fc moieties to yield dimeric, such as divalent, variant CTLA-4-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant CTLA-4 polypeptides are transformed into cells, the formation of heterodimers must be biochemically achieved since variant CTLA-4 molecules carrying the Fc-domain will be expressed as disulfide-linked homodimers as well. Thus, homodimers can be reduced under conditions that favor the disruption of interchain disulfides, but do no effect intra-chain disulfides. In some cases, different variant-CTLA-4 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant CTLA-4 polypeptide using knob-into-hole methods described below.

B. Stack Molecules with Additional IgSF Domains

In some embodiments, the immunomodulatory proteins can contain any of the variant CTLA-4 polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant CTLA-4 domain with one or more other affinity modified and/or non-affinity modified IgSF domain sequences of another IgSF family member (e.g., a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant CTLA-4 IgSF domain (vIgD of CTLA-4) according to the provided description.

In some embodiments, the sequences of the additional IgSF domains can be a modified IgSF domain that contains one or more amino acid modifications, e.g. substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 1. In some embodiments, the additional IgSF domain can be an affinity-modified IgSF domain containing one or more amino acid modifications, e.g. substitutions, compared to an IgSF domain contained in an IgSF family member set forth in Table 1.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L1, B7-H1), PDCD1LG2 (PD-L2, CD273), ICOSLG (B7RP1, CD275, ICOSL, B7-H2), CD276 (B7-H3), VTCN1 (B7-H4), CD28, CTLA4, PDCD1 (TIGIT), ICOS, BTLA (CD272), CD4, CD8A (CD8-alpha), CD8B (CD8-beta), LAG3, HAVCR2 (TIM-3), CEACAM1, TIGIT, PVR (CD155), PVRL2 (CD112), CD226, CD2, CD160, CD200, CD200R1 (CD200R), and NCR3 (NKp30).

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one CTLA-4, and at least one of a second IgSF domain sequence whose origin is from and unique to another IgSF family member that is not CTLA-4, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

In some embodiments, the provided immunomodulatory proteins, in addition to containing a variant CTLA-4 polypeptide, also contains at least 1, 2, 3, 4, 5 or 6 additional immunoglobulin superfamily (IgSF) domains, such as an IgD domain of an IgSF family member set forth in Table 1. In some embodiments, the provided immunomodulatory protein contains at least one additional IgSF domain (e.g., a second IgSF domain). In some embodiments, the provided immunomodulatory protein contains at least two additional IgSF domains (e.g., a second and third IgSF domain). In some embodiments, the provided immunomodulatory protein contains at least three additional IgSF domains (e.g., a second, third and fourth IgSF domain). In some embodiments, the provided immunomodulatory protein contains at least four additional IgSF domains (e.g., a second, third, fourth and fifth IgSF domain). In some embodiments, the provided immunomodulatory protein contains at least five additional IgSF domains (e.g., a second, third, fourth, fifth and sixth IgSF domain). In some embodiments, the provided immunomodulatory protein contains at least six additional IgSF domains (e.g., a second, third, fourth, fifth, sixth and seventh IgSF domain). In some embodiments, each of the IgSF domains in the immunomodulatory protein is different. In some embodiments, at least one of the additional IgSF domains is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. For example, in some aspects, the immunomodulatory protein contains an ECD or portion thereof of an IgSF member containing a full-length IgV domain and a full-length IgC (e.g., IgC2) domain or domains or specific binding fragments thereof.

In some embodiments, the provided immunomodulatory proteins contain at least one additional IgSF domain (e.g., a second or, in some cases, also a third IgSF domain) in which at least one additional, e.g., a second or third IgSF domain, is an IgSF domain set forth in a wild-type or unmodified IgSF domain or a specific binding fragment thereof contained in the sequence of amino acids set forth in any of SEQ ID NOS: 1, 443-469. In some embodiments, the wild-type or unmodified IgSF domain is an IgV domain or an IgC domain, such as an IgC1 or IgC2 domain.

In some embodiments, the provided immunomodulatory proteins, in addition to containing a variant CTLA-4 polypeptide, also contains at least one additional affinity-modified IgSF domain (e.g., a second or, in some cases, also a third affinity-modified IgSF domain and so on) in which at least one additional IgSF domain is a vIgD that contains one or more amino acid modifications (e.g. substitution, deletion or mutation) compared to an IgSF domain in a wild-type or unmodified IgSF domain, such as an IgSF domain in an IgSF family member set forth in Table 1. In some embodiments, the additional, e.g., second or third affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS: 1, 443-469.

In some embodiments, the wild-type or unmodified IgSF domain is an IgV domain or an IgC domain, such as an IgC1 or IgC2 domain. In some embodiments, the additional, e.g., second or third IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g. substitution(s)). In some embodiments, the one or more additional affinity-modified IgSF domain include IgSF domains present in the ECD or a portion of the ECD of the corresponding unmodified IgSF family member, such as a full-length IgV domain and a full-length IgC (e.g., IgC2) domain or domains, or specific binding fragments thereof, in which one or both of the IgV and IgC contain the amino acid modification(s) (e.g. substitution(s)).

In some embodiments, the provided immunomodulatory protein contains at least one additional, (e.g., second or, in some cases, also a third IgSF domain and so on) IgSF domain that is a vIgD that contains one or more amino acid substitutions compared to an IgSF domain (e.g., IgV) of a wild-type or unmodified IgSF domain other than CTLA-4.

In some embodiments, the two or more IgSF domains, including a vIgD of CTLA-4 and one or more additional IgSF domain (e.g., second variant IgSF domain) from another IgSF family member, are covalently or non-covalently linked. A plurality of non-affinity modified and/or affinity modified IgSF domains in a stacked immunomodulatory protein polypeptide chain need not be covalently linked directly to one another. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

Figure 6A:
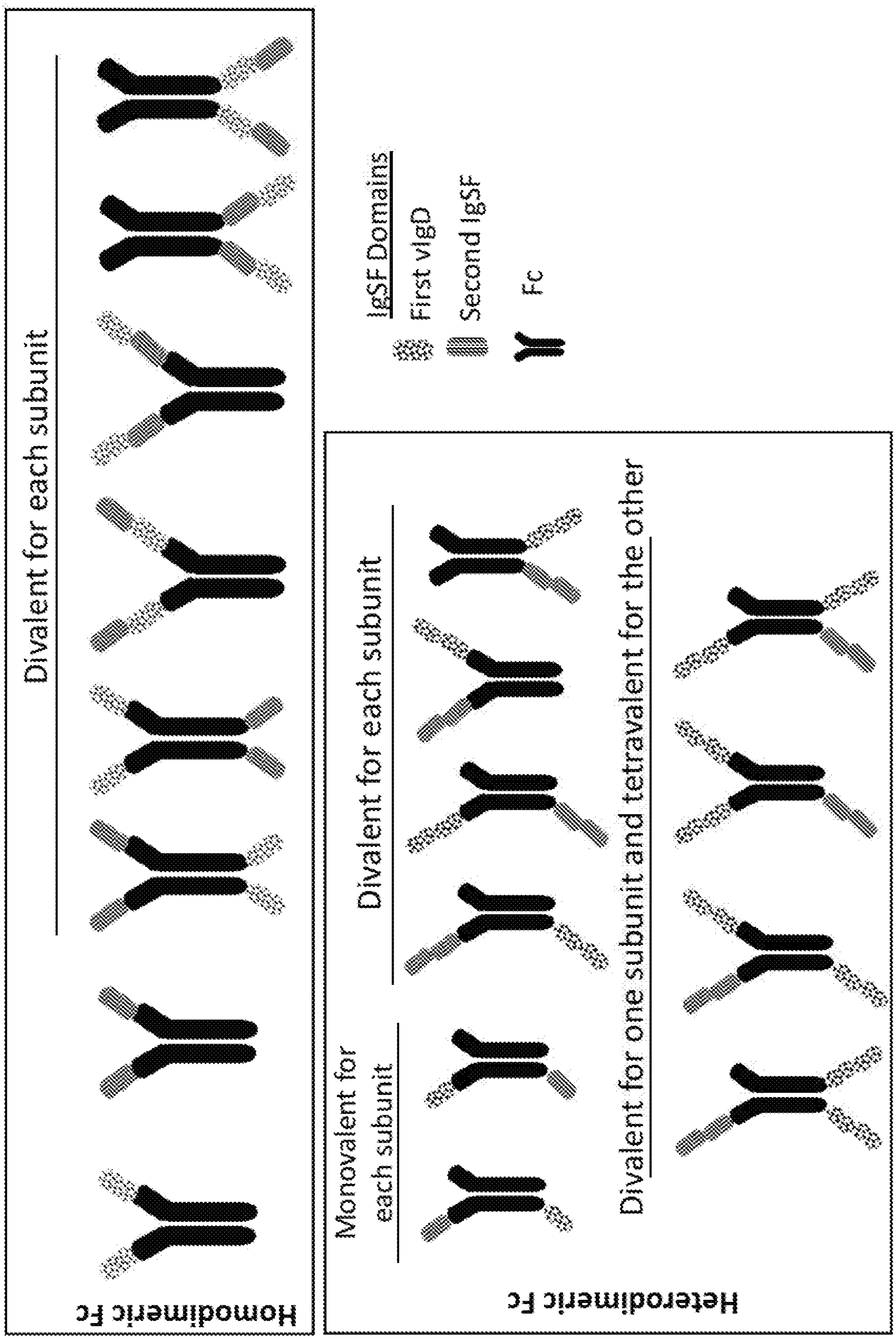
FIG. 6A depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc subunit by co-expression of the individual Fc regions in a cell. For generating a heterodimeric Fc molecule, the individual Fc regions contain mutations (e.g., "knob-into-hole" mutations in the CH3 domain), such that formation of the heterodimer is favored compared to homodimers when the individual Fc regions are co-expressed in a cell.
Figure 6B:
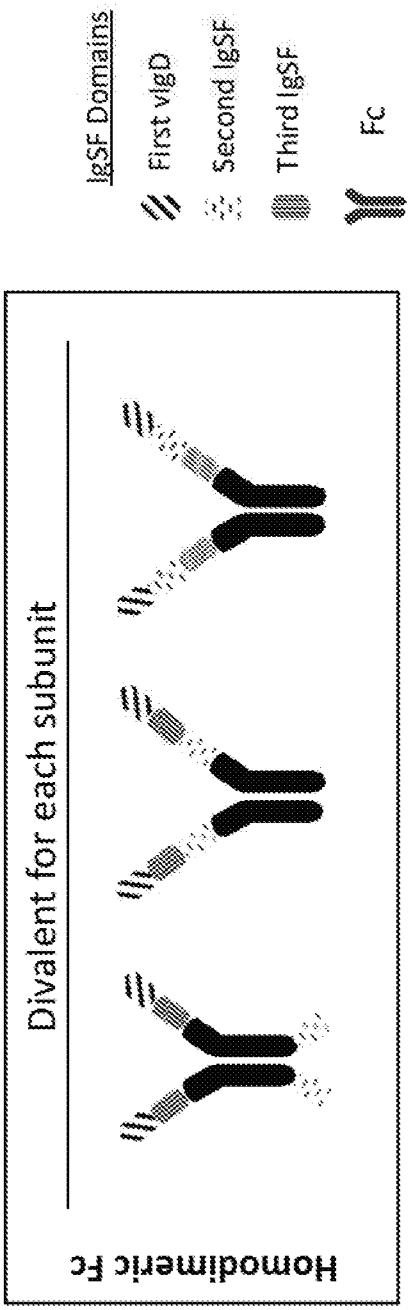
FIG. 6B depicts various exemplary configurations of a stack molecule containing a first variant IgSF domain (first vIgD), a second IgSF domain, such as a second variant IgSF domain (second vIgD), and a third IgSF domain, such as a third variant IgSF domain (third vIgD). As shown, the first vIgD, second IgSF, and third IgSF domains are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell.

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIGS. 6A and 6B.

In some embodiments, one or more "peptide linkers" link the vIgD of CTLA-4 and an additional IgSF domain (e.g., second variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is (in one-letter amino acid code): GGGGS ("4GS"; SEQ ID NO: 535 or multimers of the 4GS linker, such as repeats of 2, 3, 4, or 5 4GS linkers. In some embodiments, the peptide linker is $(GGGGS)_2$ (SEQ ID NO: 537) or $(GGGGS)_3$ (SEQ ID NO: 536). In some embodiments, the linker also can include a series of alanine residues alone or in addition to another peptide linker (such as a 4GS linker or multimer thereof; see, e.g., SEQ ID NO: 538). In some embodiments, the number of alanine residues in each series is: 2, 3, 4, 5, or 6 alanines.

In some embodiments, the non-affinity modified and/or affinity modified IgSF domains are linked by "wild-type peptide linkers" inserted at the N-terminus and/or C-terminus of a second non-affinity modified and/or affinity modified IgSF domains. These linkers are also called leading sequences (N-terminal to non-affinity modified or affinity modified IgSF domain) or trailing sequences (C-terminal to non-affinity modified or affinity modified IgSF domain), and sequences that exist in the wild-type protein that span immediately outside the structural prediction of the Ig fold of the IgSF. In some embodiments, the "wild-type linker" is an amino acid sequence that exists after the signal sequence, but before in the IgSF domain, such as the defined IgV domain, in the amino acid sequence of the wild-type protein. In some embodiments, the "wild-type" linker is an amino acid sequence that exists immediately after the IgSF domain, such as immediately after the defined IgV domain but before the IgC domain, in the amino acid sequence of the wild-type protein. These linker sequences can contribute to the proper folding and function of the neighboring IgSF domain(s).

In some embodiments, there is present a leading peptide linker inserted at the N-terminus of the first IgSF domain and/or a trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

In some embodiments, the two or more IgSF domain, including a vIgD of CTLA-4 and one or more additional IgSF domain (e.g. second and/or third variant IgSF domain) from another IgSF family member, are linked or attached to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant CTLA-4 polypeptide and one or more additional IgSF domain are independently linked, directly or indirectly, to the N- or C-terminus of an Fc region. In some embodiments, the variant CTLA-4 polypeptide and at least one of the one or more additional IgSF domain are linked, directly or indirectly, and one of the variant CTLA-4 and one of the one or more additional IgSF domain is also linked, directly or indirectly, to the N- or C-terminus of an Fc region. In some embodiments, the N- or C-terminus of the Fc region is linked to the variant CTLA-4 polypeptide or the one or more additional IgSF domain and the other of the N- or C-terminus of the Fc region is linked to the other of the CTLA-4 variant or another of the one or more additional IgSF domain. In some embodiments, linkage to the Fc is via a peptide linker, e.g., a peptide linker, such as described above. In some embodiments, linkage between the variant CTLA-4 and second IgSF domain is via a peptide linker, e.g., a peptide linker, such as described above. In some embodiments, linkage between the variant CTLA-4 and the one or more additional IgSF domain is via a peptide linker, e.g., a peptide linker, such as described above. In some embodiments, the vIgD of CTLA-4, the one or more additional IgSF domains, and the Fc domain can be linked together in any of numerous configurations as depicted in FIGS. 6A and 6B. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc region polypeptides, such as described above in accord with generating dimeric Fc fusion proteins.

In some embodiments, the dimeric multi-domain stack immunomodulatory protein is divalent for each Fc subunit, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same.

In some embodiments, the multi-domain stack molecule contains a first Fc fusion polypeptide containing a variant CTLA-4 and a second IgSF domain and a second Fc fusion polypeptide containing the variant CTLA-4 and the second IgSF domain. In some embodiments, the multi-domain stack molecule contains a first Fc fusion polypeptide containing a variant CTLA-4, a second IgSF domain, and a third IgSF domain and a second Fc fusion polypeptide containing the variant CTLA-4, the second IgSF domain, and the third IgSF domain. In some embodiments, the Fc portion of the first and/or second fusion polypeptide can be any Fc as described above. In some embodiments, the Fc portion or region of the first and second fusion polypeptide is the same.

In some embodiments, the multi-domain stack molecule is heterodimeric, comprising two different Fc fusion polypeptides, e.g., a first and a second Fc polypeptide, wherein at least one is an Fc fusion polypeptide containing at least one variant CTLA-4 polypeptide and/or at least one is an Fc polypeptide containing a second IgSF domain (e.g., second variant IgSF domain). In some embodiments, the first or second Fc fusion polypeptide further contains a third IgSF domain (e.g., third variant IgSF domain). In some embodiments, the multi-domain stack molecule contains a first Fc fusion polypeptide containing a variant CTLA-4 and a second Fc fusion polypeptide containing at a second IgSF domain, in which, in some cases, the first or second Fc fusion polypeptide additionally contains a third IgSF domain. In some embodiments, the multi-domain stack molecule contains a first Fc fusion polypeptide containing a variant CTLA-4, a second IgSF domain, and in some cases, a third IgSF domain and a second Fc fusion polypeptide that is not linked to either a variant CTLA-4 polypeptide or an additional IgSF domain. In some embodiments, the Fc portion or region of the first and second fusion polypeptide is the same. In some embodiments, the Fc portion or region of the first and second fusion polypeptide is different. In some embodiments, the multi-domain stack molecule contains a first fusion Fc polypeptides containing 1, 2, 3, 4 or more variant CTLA-4 polypeptides and 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc fusion polypeptide contains 1, 2, 3, 4 or more variant CTLA-4 polypeptides and 1, 2, 3, 4 or more additional IgSF domains, wherein the total number of IgSF domains in the second stack Fc fusion polypeptide is greater than 2, 3, 4, 5, 6 or more. In another example of such embodiments, the second Fc polypeptide is not linked to either a variant CTLA-4 polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant CTLA-4 polypeptide and/or second IgSF domain (e.g., second variant IgSF domain) and a second Fc polypeptide fusion containing an Fc region and the other of the first variant CTLA-4 polypeptide or the second IgSF domain. In some embodiments, a heterodimeric stack molecule contains a first Fc polypeptide fusion containing an Fc region and a first variant CTLA-4 polypeptide and/or second IgSF domain (e.g., second variant IgSF domain) and a second Fc polypeptide fusion containing an Fc region and both the first variant CTLA-4 polypeptide and second IgSF domain (e.g., second variant IgSF domain) but in a different orientation or configuration from the first Fc region. In some embodiments, the first and/or second Fc fusion polypeptide also contains a third IgSF domain (e.g., third variant IgSF domain).

In some embodiments, the Fc domain of one or both of the first and second stacked immunomodulatory Fc fusion polypeptide comprises a modification (e.g., substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a sequence of amino acids is added preceding the Fc sequence for constructs in which the Fc sequence is the N-terminal portion of the sequence. In some cases, the sequence of amino acids HMSSVSAQ (SEQ ID NO: 539) is added immediately preceding the Fc sequence for constructs in which the Fc sequence is the N-terminal portion of the sequence. In some embodiments, a heterodimeric stack molecule contains a first Fc polypeptide fusion containing an Fc region (knob) and a first variant CTLA-4 polypeptide and/or second IgSF domain (e.g., second variant IgSF domain) and a second Fc polypeptide fusion containing an Fc region (hole) and a stuffer sequence HMSSVSAQ (SEQ ID NO: 539) added immediately preceding both Fc regions of the first and second Fc polypeptide fusion.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 Å2 from each surface (see, e.g., Deisenhofer (1981), *Biochemistry,* 20(9):2361-2370; Miller (1990), *J Mol. Biol.,* 216(4):965-973; Ridgway et al. (1996), *Prot. Eng.,* 9(7):617-621; U.S. Pat. No. 5,731,168). Modifications of a CH3 domain to create protuberances or cavities are described, for example, in U.S. Pat. No. 5,731,168; International Patent Applications WO98/50431 and WO 2005/063816; and Ridgway et al. (1996), *Prot. Eng.,* 9(7): 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant et al. (1998), *Nature Biotech.,* 16(7):677-681), e.g., by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, the Fc regions of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance (knob) or cavity (hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

C. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments, any one or combination of any two or more of the foregoing moieties can be attached to the Fc or to the variant CTLA-4 polypeptide or to both. In some embodiments, the provided conjugates, such as fusion polypeptides, can be used in methods and uses for inhibiting or attenuating an immune response, such as in connection with treating autoimmunity or inflammatory indications.

In some embodiments, the moiety can be a targeting moiety, a small molecule drug (non-polypeptide drug of less than 500 daltons molar mass), a toxin, a cytostatic agent, a cytotoxic agent, an immunosuppressive agent, an anti-proliferative agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a therapeutic immunosuppressive agent or antirejection medication, which provides some therapeutic benefit.

In some embodiments, the effector moiety is a targeting moiety or agent, such as an agent that targets a cell surface antigen, e.g., an antigen on the surface of an immune cell or activated immune cell. In some embodiments, the effector moiety is a label, which can generate a detectable signal, either directly or indirectly. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more binding partner as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue, such as a lymphatic tissue, an immune cell, such as an activated immune cell or non-activated immune cell, and/or a tissue of an inflammatory environment, in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, an IgSF conjugate, through its targeting agent, will be localized to, such as bind to, a cellular component of an immune cell, tissue of an inflammatory environment, or lymphatic tissue, such as spleen, tonsils, lymph vessels, lymph nodes, adenoids, and/or liver tissue, thereby modulating localized cells of the immune response. In some embodiments, the targeting agent facilitates delivery of the conjugated IgSF (e.g., vIgD) to the immune cell, such as to interact with its binding partner to alter signaling of nearby immune cells (e.g., NK cells, monocytes/macrophages, dendritic cells, T cells, B cells) bearing the binding partner and/or bearing the co-stimulatory receptor for the binding partner. In some embodiments, localized delivery mediates an indirect antagonizing or blocking activity of the CD28 and/or ICOS costimulatory receptor(s).

In some embodiments, the targeting agent is an immunoglobulin. As used herein, the term “immunoglobulin” includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term “antibody,” as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule. Exemplary immunoglobulin molecules include immunoglobulin molecules directed against CD20, CD25, or CD3, such as anti-CD20, anti-CD25 or anti-CD3 monoclonal antibodies. Other exemplary immunoglobulin molecules include immunoglobulin molecules directed to integrin molecules, such as alpha-4 integrin.

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety prevents activation and/or proliferation of immune cells (e.g. NK cells, monocytes/macrophages, dendritic cells, T cells) by, for example, binding or interfering with TCR complexes, inhibiting tumor necrosis factor (TNF), inhibiting interleukins, or binding and inhibiting CD25 (IL-2a), thereby preventing clonal expansion of activated lymphocytes and shortening lymphocyte survival. In other embodiments, an antibody/targeting moiety prevents adhesion of inflammatory immune cells to inflamed tissues by binding or inhibiting integrins, such as alpha-4 integrin or integrin beta-3.

Examples of antibodies which can be incorporated into IgSF conjugates include but are not limited to antibodies such as Muromonab-CD3, basiliximab (Simulect®) and daclizumab (Zenapax®), natlizumab (TYSABRI®), abciximab (ReoPro®), rituximab (Rituxan®; MabThera®), alemtuzumab (Campath®; Campath-1H®; Mabcampath®), infliximab (Remicade®), guselkumab (Tremfya™), adalimumab (Humira®), certolizumab (Cimzia®), ustekinumab (Stelara®), secukinumab (Cosentyx®), brodalumab (Siliq™), or tocilizumab (Actemra®). Antibodies to other particular target epitopes can also be generated using conventional methods, and used as a conjugate with any of the variant CTLA-4 polypeptides described herein.

In some embodiments, an IgSF conjugate comprises a targeting agent which can bind/target a cellular component, such as a tumor antigen. In some aspects, a cellular component, antigen or molecule can each be used to mean, a desired target for a targeting agent. For example, in various embodiments, a targeting agent is specific for or binds to a component, which includes but is not limited to, epidermal growth factor receptor family, e.g., ErbB-2 (HER2/neu); gangliosides (such as GD2, GD3, GM1 and GM2); PDGF receptor (PDGFR; such as PDGF-R a); and vascular endothelial growth factor receptor (VEGFR) family, VEGF family. Examples of antibodies which can be incorporated into IgSF conjugates include but are not limited to antibodies such as Pertuzumab (Perjeta®), Olaratumab (Lartruvo™), Dinutuximab (Unituxin™), or Ramucirumab (Cyramza®) or an antigen-binding fragment thereof.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

Figure 5A:
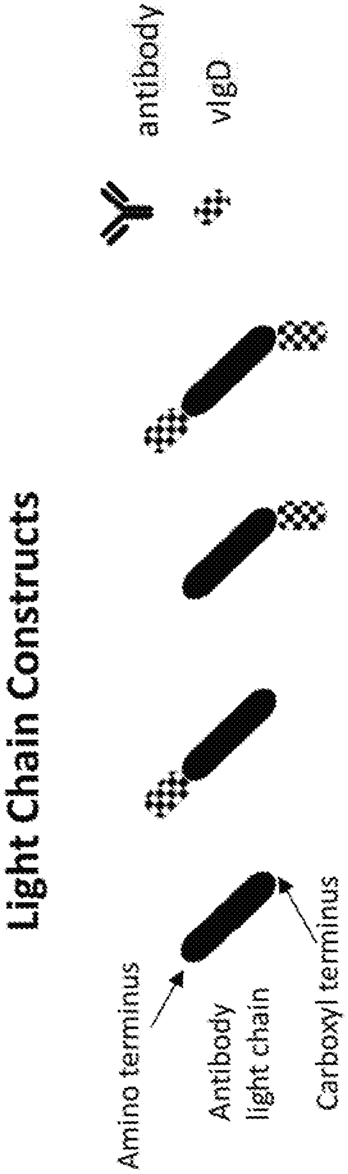
FIGS. 5A-5C depict various exemplary configurations of a variant IgSF-antibody conjugate (V-Mab).
Figure 5B:
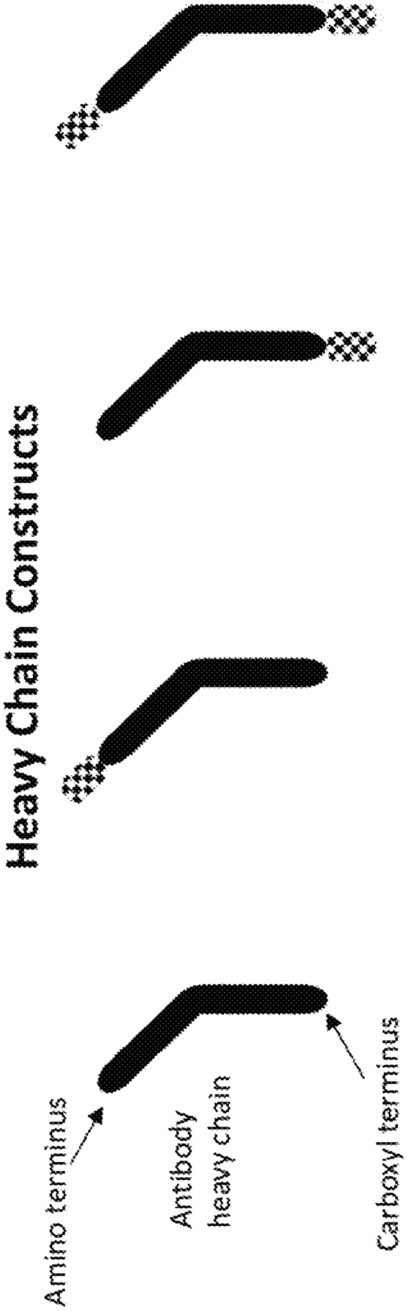
Figure 5C:
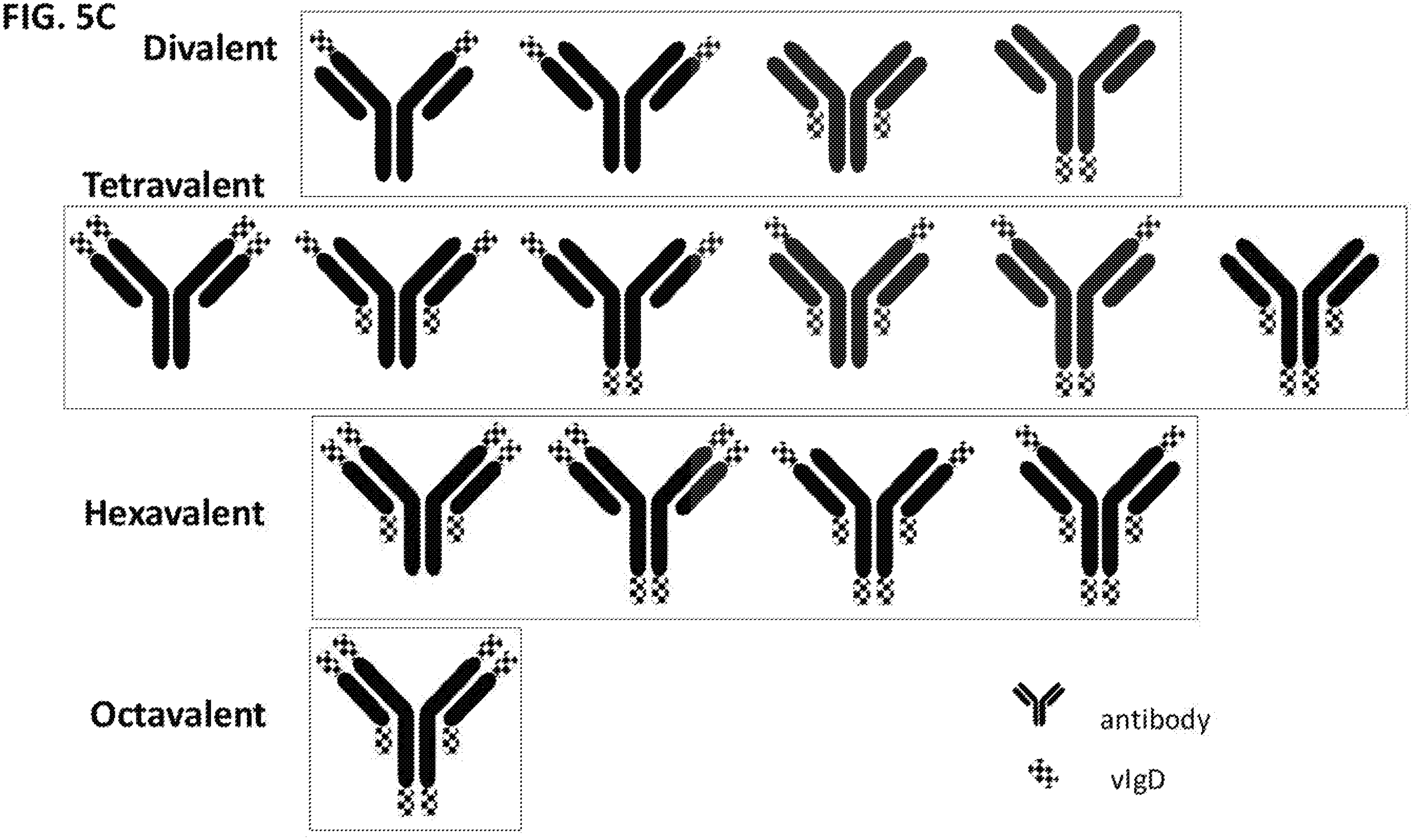

In some embodiments, the vIgD is linked, directly or indirectly, to the N- or C-terminus of the light and/or heavy chain of the antibody. In some embodiments, linkage can be via a peptide linker, such as any described above. Various configurations can be constructed. FIG. 5A-5C depict exemplary configurations. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in an immune cell, lymphatic tissues, a tumor cell, tumor vasculature, and/or tumor microenvironment, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of an inflammatory environment, an immune cell, or a lymphatic tissue. Therefore, such IgSF conjugates of the invention comprise peptide targeting agents which bind to a cellular component of an immune cell, lymphatic tissue, and/or a component of an inflammatory microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vvβ3. Integrin Vvβ3 is expressed on a variety of cells and has been shown to mediate several biologically relevant processes, including adhesion of immune cells to blood vessel walls and accumulation in inflamed tissues and for transmigration of immune cells out of the blood vessels. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, *Bioorganic & Medicinal Chem Lett,* 12(2):159-163 (2002); Lin et al., *Bioorganic & Medicinal Chem Lett,* 12(2):133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, glucocoriticoids, such as prednisone, dexamethasone, and hydrocortisone, interleukin inhibitors, such as interleukin 1 (IL-1), IL-2, IL-3, IL-4, IL-5, IL-6, IL-8 inhibitors, TNF-alpha inhibitors. In some embodiments, the therapeutic agent includes a cytostatic agent or an inhibitor of cell division, such as purine analogs, alkylating agents, such as nitrogen mustards (cyclophosphamide), nitrosoureas (e.g., arabinopyranosyl-N-methyl-N-nitrosourea (Aranose), carmustine (BCNU, BiCNU), chlorozotocin, ethylnitrosourea (ENU), fotemustine, lomustine (CCNU), nimustine, N-Nitroso-N-methylurea (NMU), ranimustine (MCNU), semustine, streptozocin (streptozotocin), and platinum compounds, antimetabolics, such as folic acid analogs (e.g., methotrexate), purine analogs (e.g., azathioprine and mercaptopurine), pyrimidine analogs (e.g., fluorouracil), or protein synthesis inhibitors, cytotoxic antiobiotics, such as dactinomycin, anthracyclines, mitomycin C, bleomycin, or mithramycin. In some embodiments, the therapeutic agent includes drugs acting on immunophilins, such as cyclosporine, tacrolimus, sirolimus, or everolimus. In some embodiments, the therapeutic agent includes orther immunosuppressant drugs, such as interferons, opioids, TNF binding proteins (e.g., setanercept (Enbrel®)), mycophenolate, or small biological agents, such as fingolimod or myriocin.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 123I, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Crosslinking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatible crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter and Greenwood, *Nature,* 194:495-6 (1962); David and Resifeld, *Biochemistry,* 13(5):1014-1021 (1974); Pain and Surolia, *J. Immunol. Meth.,* 40(2):219-230 (1981); Nygren (1982), *J. Histochem. and Cytochem.,* 30:407; Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", *Meth. Enzymol.,* 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as $^{99}$Tc or $^{123}$I $^{186}$Re, $^{188}$Re and $^{111}$In can be attached via a cysteine residue in the peptide. Yttrium-90 can be attached via a lysine residue. The IODOGEN method (Fraker et al., *Biochem. Biophys. Res. Commun.,* 80(4):849-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., *Cancer Res.,* 52(1):127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

D. Transmembrane and Secretable Immunomodulatory Proteins and Engineered Cells

Provided herein are engineered cells which express the immunomodulatory variant CTLA-4 polypeptides (alternatively, "engineered cells"). In some embodiments, the expressed immunomodulatory variant CTLA-4 polypeptide is a transmembrane proteins and is surface expressed. In some embodiments, the expressed immunomodulatory variant CTLA-4 polypeptide is expressed and secreted from the cell.

1. Transmembrane Immunomodulatory Proteins

In some embodiments, an immunomodulatory polypeptide comprising a variant CTLA-4 can be a membrane bound protein. As described in more detail below, the immunomodulatory polypeptide can be a transmembrane immunomodulatory polypeptide comprising a variant CTLA-4 in which is contained: an ectodomain containing an affinity modified IgSF domain (IgV), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g., T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g., amino acid substitutions) of the variant CTLA-4 of the invention. Thus, for example, in some embodiments a transmembrane protein will comprise an ectodomain that comprises one or more amino acid substitutions of a variant CTLA-4 of the invention.

In some embodiments, the engineered cells express variant CTLA-4 polypeptides that are transmembrane immunomodulatory polypeptides (TIPs) that can be membrane proteins, such as transmembrane proteins. In typical embodiments, the ectodomain of a membrane protein comprises an extracellular domain or IgSF domain thereof of a variant CTLA-4 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g., CTLA-4 or other native IgSF protein), and simply fused to the sequence of the first membrane proximal domain in a similar fashion as the native IgSF protein (e.g., CTLA-4). In some embodiments, the transmembrane immunomodulatory protein comprises a transmembrane domain of the corresponding wild-type or unmodified IgSF member, such as a transmembrane domain contained in the sequence of amino acids set forth in SEQ ID NO:1 (Table 1). In some embodiments, the membrane bound form comprises a transmembrane domain of the corresponding wild-type or unmodified polypeptide, such as corresponding to residues 162-182 of SEQ ID NO:1.

In some embodiments, the transmembrane domain is a non-native transmembrane domain that is not the transmembrane domain of native CTLA-4. In some embodiments, the transmembrane domain is derived from a transmembrane domain from another non-CTLA-4 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 540, 541, or 565, or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain.

In some embodiments, the endodomain, such as cytoplasmic signaling domain, is an inhibitory signaling domain that is or comprises an ITIM (immunoreceptor tyrosine-based inhibition motif). In some embodiments, the endodomain of the transmembrane immunomodulatory protein comprises the cytoplasmic signaling domain of the corresponding wild-type or unmodified CTLA-4 polypeptide, such as a cytoplasmic signaling domain contained in the sequence of amino acids set forth in SEQ ID NO:1 (see Table 1). In some embodiments, a provided transmembrane immunomodulatory protein that is or comprises a variant CTLA-4 comprises a sequence of amino acids that exhibits at least 85% sequence identity to SEQ ID NO: 478, such as at least 85%, 86%, 87%, 88%, 89%, 90%, 91%, 92%, 93%, 94%, 95%, 96%, 97%, 98% or 99% sequence identity to SEQ ID NO: 478, and contains an ectodomain comprising at least one affinity-modified CTLA-4 IgSF domain, as described herein, and a transmembrane domain. In some embodiments, the transmembrane immunomodulatory protein contains any one or more amino acid substitutions in an IgSF domain (e.g., IgV domain) as described, including any set forth in Table 2. In some embodiments, the variant CTLA-4 transmembrane immunomodulatory protein is capable of inducing an inhibitory cell signal, such as upon binding of the affinity-modified CTLA-4 ectodomain to one or more binding partner. In some embodiments, the variant CTLA-4 transmembrane immunomodulatory protein is capable of mediating transendocytosis of one or more binding partner (CD80, CD86 and/or ICOSL) from an antigen-presenting cell, thereby limiting availability of costimulatory signals for T cell activation, and, thus limiting or attenuating T cell activation. In some embodiments, the provided transmembrane immunomodulatory protein can be used in methods and uses for inhibiting or attenuating an immune response, such as in connection with treating autoimmunity or inflammatory indications.

Also provided herein are switch receptors in which the CTLA-4 polypeptide is switched from an inhibitory receptor to an activating receptor. In some embodiments, the CTLA-4 polypeptide contains an endodomain, such as cytoplasmic signaling domain, that is capable of inducing an activating cell signal, such as upon binding of the affinity-modified CTLA-4 ectodomain to one or more binding partner. In some embodiments, the endodomain or cytoplasmic signaling domain is an activating signaling domain that is or comprises an ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 542 or a sequence of amino acids that exhibits at least 85%, 86%, 87%, 88%, 89%, 90%, 91%, 92%, 93%, 94%, 95%, 96%, 97%, 98% or 99% to SEQ ID NO: 542 and retains the activity of T cell signaling. In some embodiments, the endodomain can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 543-546 or a sequence of amino acids that exhibits at least 85%, 86%, 87%, 88%, 89%, 90%, 91%, 92%, 93%, 94%, 95%, 96%, 97%, 98% or 99% to SEQ ID NO:543-546 and retains the activity of T cell costimulatory signaling. Thus, in some embodiments, the provided CTLA-4 transmembrane immunomodulatory polypeptides are CAR-related transmembrane immunomodulatory proteins that have features of CARs to stimulate T cell signaling upon binding of an affinity modified IgSF domain to a binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production. In some embodiments, provided switch (activating) receptors can be used in methods and uses to induce or promote an immune response, such as in connection with various oncology methods for treating cancers.

Also provided herein are decoy receptors in which the CTLA-4 polypeptide is not capable of inducing an intracellular signal upon binding of a binding partner. In some embodiments, the transmembrane immunomodulatory protein does not contain an endodomain capable of mediating cytoplasmic signaling, such as does not contain an intracellular signaling domain containing an ITIM-containing domain. Thus, in some embodiments, the transmembrane immunomodulatory protein lacks the signal transduction mechanism of the wild-type or unmodified CTLA-4 polypeptide and therefore does not itself induce cell signaling. In some embodiments, the transmembrane immunomodulatory protein lacks an intracellular (cytoplasmic) domain or a portion of the intracellular domain of the corresponding wild-type or unmodified CTLA-4 polypeptide, such as a cytoplasmic signaling domain contained in the sequence of amino acids set forth in SEQ ID NO:1 (see Table 1). Thus, in some embodiments, the transmembrane immunomodulatory protein only contains the ectodomain and the transmembrane domain, such as any as described. In some embodiments, such a decoy receptor can compete and/or eliminate the ability of CTLA-4 to inhibit effector cell activity, thereby promoting activation of an immune response. In some cases, such provided decoy receptors can be used in methods and uses to increase or potentiate an immune response, such as in connection with various oncology methods for treating cancers.

In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO:1 (see e.g., Table 1).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 478 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g., Table 1).

2. Secreted Immunomodulatory Proteins and Engineered Cells

In some embodiments, the CTLA-4 variant immunomodulatory polypeptide containing any one or more of the amino acid mutations as described herein, is secretable, such as when expressed from a cell. Such a variant CTLA-4 immunomodulatory protein does not comprise a transmembrane domain. In some embodiments, the variant CTLA-4 immunomodulatory protein is not conjugated to a half-life extending moiety (such as an Fc domain or a multimerization domain). In some embodiments, the variant CTLA-4 immunomodulatory protein comprises a signal peptide, such as an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant CTLA-4 immunomodulatory proteins that further comprise a signal peptide. In some embodiments, provided herein is a nucleic acid molecule encoding the variant CTLA-4 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type CTLA-4 (see Table 1). In some embodiments, the signal peptide is a non-native signal peptide. For example, in some embodiments, the non-native signal peptide is a mutant native signal peptide from the corresponding wild-type CTLA-4, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g., HSA or albumin), a human azurocidin preprotein signal sequence, a luciferase, a trypsinogen (e.g., chymotrypsinogen or trypsinogen) or other signal peptide able to efficiently secrete a protein from a cell. Exemplary signal peptides include any described in Table 3.

TABLE 3

| Exemplary Signal Peptides | | |
|---|---|---|
| SEQ ID NO | Signal Peptide | Peptide Sequence |
| SEQ ID NO: 547 | HSA signal peptide | MKWVTFISLLFLFSSAYS |
| SEQ ID NO: 548 | Ig kappa light chain | MDMRAPAGIFGFLL-VLFPGYRS |
| SEQ ID NO: 549 | human azurocidin preprotein signal sequence | MTRLTVLALLAGLLASSRA |
| SEQ ID NO: 550 | IgG heavy chain signal peptide | MELGLSWIFLLAILKGVQC |
| SEQ ID NO: 551 | IgG heavy chain signal peptide | MELGLRWVFLVAILEGVQC |
| SEQ ID NO: 552 | IgG heavy chain signal peptide | MKHLWFFLLLVAAPRWVLS |
| SEQ ID NO: 553 | IgG heavy chain signal peptide | MDWTWRILFLVAAATGAHS |
| SEQ ID NO: 554 | IgG heavy chain signal peptide | MDWTWRFLFVVAAATGVQS |
| SEQ ID NO: 555 | IgG heavy chain signal peptide | MEFGLSWLFLVAILKGVQC |
| SEQ ID NO: 556 | IgG heavy chain signal peptide | MEFGLSWVFLVALFRGVQC |
| SEQ ID NO: 557 | IgG heavy chain signal peptide | MDLLHKNMKHLWFFLLL-VAAPR WVLS |
| SEQ ID NO: 558 | IgG Kappa light chain signal sequences | MDMRVPAQLLGLLLL-WLSGARC |
| SEQ ID NO: 559 | IgG Kappa light chain signal sequences | MKYLLPTAAAGLLLLAAQ-PAMA |
| SEQ ID NO: 560 | Gaussia luciferase | MGVKVLFALICIAVAEA |
| SEQ ID NO: 561 | Human albumin | MKWVTFISLLFLFSSAYS |
| SEQ ID NO: 562 | Human chymo-trypsinogen | MAFLWLLSCWALLGTTFG |
| SEQ ID NO: 563 | Human interleukin-2 | MQLLSCIALILALV |

TABLE 3-continued

| Exemplary Signal Peptides | | |
|---|---|---|
| SEQ ID NO | Signal Peptide | Peptide Sequence |
| SEQ ID NO: 564 | Human trypsinogen-2 | MNLLLILTFVAAAVA |

In some embodiments of a secretable variant CTLA-4 immunomodulatory protein, the immunomodulatory protein comprises a signal peptide when expressed, and the signal peptide (or a portion thereof) is cleaved from the immunomodulatory protein upon secretion.

In some embodiments, the engineered cells express variant CTLA-4 polypeptides that are secreted from the cell. In some embodiments, such a variant CTLA-4 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptides. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on or in a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, regulatory T cells, T helper cells, cytotoxic T-cells (alternatively, cytotoxic T lymphocytes or CTLs), natural killer T-cells, memory T-cells, or gamma delta T-cells. In some embodiments, the engineered T cells are CD4+ or CD8+. In some aspects the engineered T cells can be activated T cells. In some embodiments, the engineered T cells are regulatory T cells (Treg). In some embodiments, the engineered T cells are capable of CTLA-4-mediated transendocytosis of one or more binding partner from opposing cells, such as APCs. In some embodiments, the engineered T cells exhibit increased transendocytosis of one or more binding partner, CD80, CD86, and/or ICOSL, as compared to unmodified T cells or T cells expressing an unmodified CTLA-4.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with inflammatory and autoimmune disorders, cancer, or a viral infection. In specific embodiments, the antigen-binding receptor contains an antigen-binding moiety that specifically binds a tumor specific antigen or a tumor associated antigen. In some embodiments, the TIP protein is expressed in an engineered T-cell receptor cell or an engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

In some embodiments, the engineered T-cell is a CAR (chimeric antigen receptor) T-cell in which is expressed a CAR containing an antigen-binding domain (e.g., scFv) that specifically binds to an antigen, such as an immune cell-specific antigen, lymphatic tissue-associate antigen or inflammatory tissue-associated antigen. Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular antigen, e.g. tumor antigen, linked to an intracellular signaling part comprising an activating domain and, in some cases, a costimulatory domain. The activating domain can be derived from, e.g., CD3, such as CD3 zeta, epsilon, delta, gamma, or the like. In some embodiments, the intracellular signaling domain comprises an ITAM signaling domain, such as a CD3zeta signaling domain. In some embodiments, the CAR further includes a costimulatory signaling domain. The costimulatory domain can be derived from, e.g., CD28, OX-40, 4-1BB/CD137 or inducible T cell costimulator (ICOS). In certain embodiments, the CAR is designed to have two, three, four, or more costimulatory domains. The CAR scFv can be designed to target an antigen expressed on a cell associated with a disease or condition, e.g. a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety. In some embodiments, the CAR further contains a spacer between the antigen-binding domain and a transmembrane domain.

In some embodiments, the spacer and transmembrane domain are the hinge and transmembrane domain derived from CD8 such as having an exemplary sequence set forth in SEQ ID NO: 540, 541, or 565 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 540, 541, or 565. In some embodiments, the endodomain comprises at CD3-zeta signaling domain. In some embodiments, the CD3-zeta signaling domain comprises the sequence of amino acids set forth in SEQ ID NO: 542 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:542 and retains the activity of T cell signaling.

In some embodiments, the endodomain of a CAR, can further comprise a costimulatory signaling domain or region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 543-546 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:543-546 and retains the activity of T cell costimulatory signaling.

In some embodiments, the construct encoding the CAR further encodes a second protein, such as a marker, e.g. detectable protein, separated from the CAR by a self-cleaving peptide sequence. In some embodiments, the self-cleaving peptide sequence is an F2A, T2A, E2A or P2A self-cleaving peptide. Exemplary sequences of a T2A self-cleaving peptide are set for the in any one of SEQ ID NOS: 566-568 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 566-568. In some embodiments, the T2A is encoded by the sequence of nucleotides set forth in SEQ ID NO:567 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 567. In some embodiments, the marker is a detectable protein, such as a fluorescent protein, e.g., a green fluorescent protein (GFP) or blue fluorescent protein (BFP). Exemplary sequences of a fluorescent protein marker are set forth in SEQ ID NO: 98, 105, 380, or 387 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 98, 105, 380, or 387.

In another embodiment, the engineered T-cell possesses a TCR, including a recombinant or engineered TCR. In some embodiments, the TCR can be a native TCR. In some embodiments the TCR is specific for a pre-determined antigen-MHC complex. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory protein of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant CTLA-4. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. A standard in vitro cytotoxicity, proliferation, or cytokine assays (e.g., IFN-gamma expression) can be used to assess the function of engineered T-cells. Exemplary standard endpoints are percent lysis of antigen-expressing target cells, proliferation of the engineered T-cell, IFN-gamma protein expression in culture supernatants. An engineered T cell containing a variant CTLA-4 TIP that results in statistically significant modulation of such inputs, such as increased or reduced lysis of target cells, increased or reduced proliferation of the engineered T-cell, or increased or decreased IFN-gamma expression over the control construct can be selected for. In some embodiments, an engineered cell that results in reduced lysis of target cells, reduced proliferation and/or reduced IFN-gamma expression compared to a control construct is selected for and/or indicates expression of the TIP attenuates immune cell activity. In some embodiments, the control construct is a wild-type or unmodified CTLA-4 polypeptide, such as a full-length wild-type or unmodified CTLA-4 that is expressed on the surface of the T cell. Additionally, non-engineered, such as native primary or endogenous, T-cells could also be incorporated into the same in vitro assay to measure the ability of the immunomodulatory polypeptide construct expressed on the engineered cells, such as engineered T-cells, to modulate activity, including, in some cases, to decrease effector function in bystander, native T-cells. Expression of activation markers such as CD69, CD44, or CD62L could be monitored on endogenous T cells. In some cases, altered, such as decreased, proliferation and/or cytokine production could indicate desired activity of the immunomodulatory protein expressed on the engineered T cells.

In some aspects, transendocytosis/acquisition assays can be carried out to assess if a cell engineered with a CTLA-4 TIP exhibits enhanced or increased transendocytosis of a binding partner expressed on an APC, such as enhanced or increased transendocytosis of CD80, CD86 and/or ICOSL on APCs. Assays to assess transendocytosis are known (see, e.g., Hou et al. (2015), *J. Immunol.,* 194(5):2148-59; Soskic et al. (2014), *Adv. Immunol.,* 124:95-136; Qureshi et al. (2011), *Science,* 332(6029):600-603)). In some aspects, APCs can be co-cultured with T cells expressing a CTLA-4 TIP under conditions to induce or stimulate T cell activation, and immunostaining can be carried out to assess cell surface expression of CD80, CD86, and/or ICOSL on APCs. An engineered construct which results in statistically significant decreased surface immunostaining of CD80, CD86, and/or ICOSL on APCs over the control construct can be selected for.

E. Infectious Agents for Expressing Variant Polypeptides and Immunomodulatory Proteins Also provided are infectious agents that contain nucleic acids encoding any of the variant polypeptides, such as CTLA-4 vIgD polypeptides, including secretable or transmembrane immunomodulatory proteins described herein. In some embodiments, such infectious agents can deliver the nucleic acids encoding the variant immunomodulatory polypeptides described herein, such as CTLA-4 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as CTLA-4 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as CTLA-4 vIgD polypeptides, including secretable or transmembrane immunomodulatory proteins, described herein, and by virtue of contact and/or infection of a cell in the subject, the cell expresses the variant polypeptides, such as CTLA-4 vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be contacted with cells from the subject ex vivo.

In some embodiments, the variant polypeptides, such as CTLA-4 vIgD polypeptides, including transmembrane immunomodulatory proteins, expressed by the cell infected by the infectious agent is a transmembrane protein and is surface expressed. In some embodiments, the variant polypeptides, such as CTLA-4 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include an immune cell and/or an antigen-presenting cell (APC). In some embodiments, the infectious agent targets a cell in the tumor microenvironment (TME). In some embodiments, the infectious agent delivers the nucleic acids encoding the variant polypeptides, such as CTLA-4 vIgD polypeptides, including secretable or transmembrane immunomodulatory proteins, to an appropriate cell (for example, a T cell that recognizes peptide/MHC on an APC such as a Treg cell) or tissue (e.g., lymphoid tissue) that modulates an immune response and/or a specific cell-medicated immune response. In some embodiments, the infectious agent targets a T cell, such as a regulatory T cell (Treg). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kirn and Thorne (2009), *Nat Rev Cancer,* 9(1):64-71; Garcia-Aragoncillo et al. (2010), *Curr Opin Mol Ther,* 12(4):403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650. In some embodiments, the additional gene product can be a therapeutic gene product that can result in death of the target cell (e.g., immune cell) or gene products that can inhibit or suppress or regulate an immune response (e.g., cytokine). Exemplary gene products also include an immunomodulatory molecule, an immune checkpoint activator, an antibody, a cytokine, a growth factor, an antigen, a cytotoxic gene product, a pro-apoptotic gene product, an anti-apoptotic gene product, a cell matrix degradative gene, and other genes described herein or known to one of skill in the art.

1. Viruses

In some embodiments, the infectious agent is a virus. In some embodiments, the infectious agent is a virus that targets particular cells, e.g., immune cells. In some embodiments, the infectious agent targets an immune cell or a T cell.

In some embodiments, the virus is an adenovirus (Ad); adeno-associated virus (AAV); herpes simplex virus (HSV); retroviral vector, such as Moloney murine leukemia virus (MMLV); hybrid retrovirus (e.g., containing various retroviral LTRs on their 5' end, optimal for production of high-titer viral stocks, and spleen focus-forming virus (SFFV) LTR on 3' end); lentiviral vector, such as human immunodeficiency virus (HIV-1), HIV-2, bovine lentivirus, feline lentivirus, or simian lentivirus; self-inactivating vector (SIV).

In some embodiments, the infectious agent is a modified herpes simplex virus. In some embodiments, the infectious agent is a modified version of Talimogene laherparepvec (also known as T-Vec, IMLYGIC™ or OncoVex GM-CSF), that is modified to contain nucleic acids encoding any of the variant immunomodulatory polypeptides described herein, such as variant CTLA-4 polypeptide described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, wherein the infectious agent is a virus, the tropism of viral particles is modified so that only cells expressing particular surface markers are transduced.

2. Bacteria

In some embodiments, the infectious agent is a bacterium. For example, in some embodiments, the bacteria can deliver nucleic acids encoding any of the variant CTLA-4 polypeptide or immunomodulatory polypeptides described herein to a target cell in the subject, such as a tumor cell or an immune cell. In some embodiments, the bacterium can be preferentially targeted to a specific environment within a subject, such as an inflammatory environment, for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., certain immune cells or tissue types). In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., immune cells. In some embodiments, the bacterium can contain and/or release nucleic acid sequences and/or gene products in the cytoplasm of the target cells, thereby killing the target cell, e.g., immune cell. In some embodiments, the infectious agent is bacterium that can replicate specifically in a particular environment in the subject, e.g., inflammatory environment. For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the inflammatory environment, can act as chemoattractants to attract the bacterium to the environment. In some embodiments, the bacterium can express and/or secrete the immunomodulatory proteins described herein in the environment, e.g., inflammatory environment.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria*

*monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009), *Mol Ther.,* 17(5):767-777; Baban et al. (2010), *Bioeng. Bugs,* 1(6):385-394; Patyar et al. (2010), *J Biomed Sci,* 17(1):21; Tangney et al. (2010), *Bioeng. Bugs,* 1(4): 284-287; van Pijkeren et al. (2010), *Hum Gene Ther.,* 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

F. Nucleic Acids, Vectors and Methods for Producing the Polypeptides or Cells

Provided herein are isolated or recombinant nucleic acids collectively referred to as “nucleic acids” which encode any of the various provided embodiments of the variant CTLA-4 polypeptides or immunomodulatory polypeptides provided herein. In some embodiments, nucleic acids provided herein, including all described below, are useful in recombinant production (e.g., expression) of variant CTLA-4 polypeptides or immunomodulatory polypeptides provided herein. In some embodiments, nucleic acids provided herein, including all described below, are useful in expression of variant CTLA-4 polypeptides or immunomodulatory polypeptides provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant CTLA-4 polypeptides or immunomodulatory polypeptides provided herein.

Also provided herein are engineered cells, such as engineered immune cells, containing any of the provided nucleic acids or encoded variant CTLA-4 polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acids or encoded variant CTLA-4 polypeptides or immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant CTLA-4 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of affecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promoter is a tissue- or cell-specific promoter to restrict expression to specific cell types (e.g., T cells) or tissues. In some embodiments the nucleic acid molecule includes tissue-specific promoters and enhancers. Exemplary tissue-specific promoters, target tissues and autoimmune diseases associated with the specified target tissue(s) are set forth in Table 4.

TABLE 4

| Tissue-specific promoters | | |
|---|---|---|
| Promoter | Target tissue | Disease |
| Salivary gland amylase promoter | Salivary gland; Epithelial cells acinar | Sjogren’s syndrome |
| Kallikrein promoter | Salivary gland; Epithelial cells ductal | Sjogren’s syndrome |
| Involucrin promoter | Keratinocyte | Scleroderma |
| Keratin 14 promoter | Basal layer of epidermis | Scleroderma |
| Murine albumin gene | Liver (hepatocytes) | Diabetes and other autoimmune diseases |
| L-type pyruvate kinase promoter | Liver (hepatocytes) | Diabetes and other autoimmune diseases |
| Rat insulin promoter | Pancreatic β-islet cells | Diabetes |
| Collagen II promoter | Joints (chondrocytes) | Rheumatoid Arthritis |
| Human glial fibrillary acidic protein promoter | Brain (astrocytes) | Multiple Sclerosis |
| Neuron-specific enolase promoter | Brain (neurones) | Multiple Sclerosis |
| Targeting immune cells | | |
| Interleukin-2 promoter | Activated T cells | All autoimmune diseases |

TABLE 4-continued

| Tissue-specific promoters | | |
|---|---|---|
| Promoter | Target tissue | Disease |
| MHC-II specific HLA-DRα promoter | APC | All autoimmune diseases |
| Dectin-2 promoter | Langerhans cells; (Dendritic cells) | All autoimmune diseases |
| GATA-1 enhancer + lentiviral LTR | Erythroid cells | All autoimmune diseases |

In some embodiments, the promotor is an inducible promotor, which may be responsive to an inducing agent (such as a T cell activation signal) or a condition of a targeted environment, such as hypoxia.

In some embodiments the nucleic acid molecule includes a condition-dependent promoter. In such embodiments a promoter is selected to regulate gene expression in a disease-related manner. Exemplary condition-dependent promoters include hypoxic gene regulatory systems that utilize one or more hypoxic response elements (HRE) and transcription mediated by the transcription factor HIF-1, which is assembled under hypoxic conditions, such as during inflammation, e.g., in inflamed joints. In some embodiments, glucose or insulin-responsive promoters or elements, such as glucose response elements (GRE) and/or insulin-like growth factor binding protein-1 basal promoter, can be included in the provided nucleic acid molecules, for use or administration, for example, to patients with a glucose-related disorder, such as diabetes.

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g., published International PCT Appl. No. WO 01/30843), to allow regulated expression of the encoded polypeptide. An exemplary regulatable promoter system is the Tet-On (and Tet-Off) system available, for example, from Clontech (Palo Alto, Calif.). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors). Other exemplary inducible promoters of the tetracycline systems include repressor (tetR), rapamycin, ecdysone, mifepristone, and streptogramin systems.

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof. "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g. CHO-S cells. In some examples, the cell line is a CHO cell line that is deficient in DHFR (DHFR-), such as DG44 and DUXB11. In some embodiments, the cell is deficient in glutamine synthase (GS), e.g., CHO-S cells, CHOK1 SV cells, and CHOZN((R)) GS−/− cells. In some embodiments, the CHO cells, such as suspension CHO cells, may be CHO-S-2H2 cells, CHO-S-clone 14 cells, or ExpiCHO-S cells.

In some embodiments, host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., *J. Virol.,* 80(2):985-98 (2006); Tartaglia et al., *AIDS Research and Human Retroviruses,* 8(8):1445-47 (1992); Gheradi et al., *J. Gen. Virol.,* 86(Pt 11):2925-36 (2005); Mayr et al., *Infection,* 3(1):6-14 (1975); Hu et al., *J. Virol.,* 75(21):10300-308 (2001); U.S. Pat. Nos. 5,698,530, 6,998,252, 5,443,964, 7,247,615 and 7,368,116); adenovirus vector or adenovirus-associated virus vectors (see, e.g., Molin et al., *J. Virol.,* 72(10):8358-61 (1998); Narumi et al., *Am J. Respir. Cell Mol. Biol.,* 19(6):936-41 (1998); Mercier et al., *Proc. Natl.*

*Acad. Sci. USA,* 101(16):6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., *J. Virol.,* 66(5):2731-39 (1992); Johann et al., *J. Virol.,* 66(3): 1635-40 (1992); Sommerfelt and Weiss, *Virology,* 176(1): 58-59 (1990); Wilson et al., *J. Virol.,* 63(5):2374-78 (1989); Miller et al., *J. Virol.,* 65(5):2220-24 (1991); Miller et al., *Mol. Cell Biol.,* 10(8):4239-42 (1990); Kolberg, *NIH Res.,* 4:43-44 (1992); Cornetta et al., *Hum. Gene Ther.,* 2(3):215-219 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer and Verma, *Annu. Rev. Genomics Hum. Genet.,* 2:177-211 (2001); Zufferey et al., *J. Virol.,* 72(12):9873-80 (1998); Miyoshi et al., *J. Virol.,* 72(10): 8150-7 (1998); Philpott and Thrasher, *Human Gene Therapy,* 18(6):483-9 (2007); Engelman et al., *J. Virol.,* 69(5):2729-36 (1995); Nightingale et al., *Mol. Therapy,* 13(6):1121-32 (2006); Brown et al., *J. Virol.,* 73(11):9011-20 (1999); WO 2009/076524; WO 2012/141984; WO 2016/011083; McWilliams et al., *J. Virol.,* 77(20):11150-7 (2003); Powell and Levin, *J. Virol.,* 70(8):5288-96 (1996)) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., *Mol. Cell. Biol.,* 12(3):1043-53 (1992); Todd et al., *J. Exp. Med.,* 177(6):1663-74 (1993); Penix et al., *J. Exp. Med.,* 178(5): 1483-96 (1993)). In some embodiments, the promotor is an inducible promotor, which may be responsive to an inducing agent (such as a T cell activation signal). In some embodiments, nucleic acids delivered to the target cell in the subject, e.g., immune cell, cell localized to an inflammatory environment, and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., immune cells, cells localized to an inflammatory environment, and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. METHODS OF ASSESSING ACTIVITY IMMUNE MODULATION OF VARIANT CTLA4 POLYPEPTIDES AND IMMUNOMODULATORY PROTEINS

In some embodiments, the variant CTLA-4 polypeptides provided herein (e.g. full-length and/or specific binding fragments or conjugates, stack constructs or fusion thereof or engineered cells) exhibit immunomodulatory activity to modulate T cell activation. In some embodiments, CTLA-4 polypeptides modulate IFN-gamma expression in a T cell assay relative to a wild-type or unmodified CTLA-4 control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 Sep.: 2(9):846-56), SEB (staphylococcal enterotoxin B) T cell stimulation assay (Wang et al., Cancer Immunol Res. 2014 Sep.: 2(9):846-56), and anti-CD3 T cell stimulation assays (Li and Kurlander, J Transl Med. 2010: 8: 104).

In some embodiments, a variant CTLA-4 polypeptide can in some embodiments increase or, in alternative embodiments, decrease IFN-gamma (interferon-gamma) expression in a primary T-cell assay relative to a wild-type CTLA-4 control. In some embodiments, such activity may depend on whether the variant CTLA-4 polypeptide is provided in a form for antagonist activity or in a form for agonist activity. In some embodiments, a variant CTLA-4 polypeptide or immunomodulatory protein is an antagonist of a costimulatory receptor, such as blocks a costimulatory signal from ICOS and/or CD28. Those of skill will recognize that different formats of the primary T-cell assay used to determine an increase or decrease in IFN-gamma expression exist.

In assaying for the ability of a variant CTLA-4 to increase or decrease IFN-gamma expression in a primary T-cell assay, a Mixed Lymphocyte Reaction (MLR) assay can be used. In some cases, a soluble form of a variant CTLA-4 that preferentially or specifically binds ICOSL, CD80 and/or CD86 can be employed to determine the ability of the variant CTLA-4 to antagonize T cells and thereby decrease the IFN-gamma expression in an MLR.

In some embodiments, a variant CTLA-4 polypeptide or immunomodulatory protein provided in antagonist form, such as soluble form, e.g. variant CTLA-4-Fc or secretable immunomodulatory protein, block activity of the CD28 and/or ICOS costimulatory receptor(s) and thereby decrease MLR activity in the assay, such as observed by decreased production of IFN-gamma in the assay. Thus, in some embodiments, soluble form of a variant CTLA-4 which preferentially binds ICOS can be employed to determine the ability of the variant CTLA-4 to block co-stimulatory signal in T cells and thereby decrease the IFN-gamma expression in an MLR.

In some embodiments, in assaying for the ability of a variant CTLA-4 to modulate an increase or decrease IFN-gamma expression a T cell reporter assay can be used. In some embodiments, the T cell is a Jurkat T cell line or is derived from Jurkat T cell lines. In reporter assays, the reporter cell line (e.g. Jurkat reporter cell) also is generated to overexpress a costimulatory receptor that is the binding partner of the target of the variant IgSF domain polypeptide. For example, in the case of a variant CTLA-4, the reporter cell line (e.g. Jurkat reporter cell) is generated to overexpress CD28 and/or ICOS. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter.

In aspects of a reporter assay, a reporter cell line is stimulated, such as by co-incubation with antigen presenting cells (APCs) expressing the wild-type ligand of the costimulatory receptor, e.g. ICOSL, CD80, and/or CD86. In some embodiments, the APCs are artificial APCs. Artificial APCs are well known to a skilled artisan. In some embodiments, artificial APCs are derived from one or more mammalian cell line, such as K562, CHO or 293 cells.

In some embodiments, the Jurkat reporter cells are co-incubated with artificial APCs overexpressing the costimulatory ligand in the presence of the variant IgSF domain molecule or immunomodulatory protein, e.g., variant CTLA-4 polypeptide or immunomodulatory protein. In some embodiments, reporter expression is monitored, such as by determining the luminescence or fluorescence of the cells. In some embodiments, normal interactions between its costimulatory receptor and ligand result in an enhancement of or increase in the reporter signal, such as compared to control, e.g. reporter expression by co-incubation of control T cells and APCs in which the costimulatory receptor and ligand interaction is not present, e.g. APCs that do not overexpress ICOSL, CD80, and/or CD86. In some embodiments, a variant CTLA-4 polypeptide or immunomodulatory protein provided herein antagonizes the interaction, e.g. when provided in soluble form as a variant CTLA-4-Fc or when expressed from the APC as a secretable immunomodulatory protein, thereby resulting in a decrease in the reporter signal compared to the absence of the variant CTLA-4 polypeptide or immunomodulatory protein.

Use of proper controls is known to those of skill in the art, however, in the aforementioned embodiments, a control typically involves use of the unmodified CTLA-4, such as a wild-type or native CTLA-4 isoform from the same mammalian species from which the variant CTLA-4 was derived or developed. In some embodiments, the wild-type or native CTLA-4 is of the same form or corresponding form as the variant. For example, if the variant CTLA-4 is a soluble form containing a variant ECD fused to an Fc protein, then the control is a soluble form containing the wild-type or native ECD of CTLA-4 fused to the Fc protein. Irrespective of whether the binding affinity and/or selectivity to ICOSL is increased or decreased, a variant CTLA-4 in some embodiments will decrease IFN-gamma expression and, in alternative embodiments, increase IFN-gamma expression in a T-cell assay relative to a wild-type CTLA-4 control.

In some embodiments, a variant CTLA-4 polypeptide or immunomodulatory protein, decreases IFN-gamma expression (i.e., protein expression) relative to a wild-type or unmodified CTLA-4 control by at least: 5%, 10%, 20%, 30%, 40%, 50%, 60%, 70%, 80%, 90%, or higher. In other embodiments, a variant CTLA-4 or immunomodulatory protein increases IFN-gamma expression (i.e. protein expression) relative to a wild-type or unmodified CTLA-4 control by at least: 5%, 10%, 20%, 30%, 40%, 50%, 60%, 70%, 80%, 90%, or higher. In some embodiments, the wild-type CTLA-4 control is murine CTLA-4, such as would typically be used for a variant CTLA-4 altered in sequence from that of a wild-type murine CTLA-4 sequence. In some embodiments, the wild-type CTLA-4 control is human CTLA-4, such as would typically be used for a variant CTLA-4 altered in sequence from that of a wild-type human CTLA-4 sequence, such as an CTLA-4 sequence comprising the sequence of amino acids of SEQ ID NO: 2 or SEQ ID NO: 3.

In some cases, activity of a variant CTLA-4 polypeptide or immunomodulatory proteins containing a variant CTLA-4 polypeptide as provided can be assessed using an appropriate animal model. In some embodiments, the animal model is a model of autoimmune disease. Animal models of autoimmune activities include spontaneous animal models, such as spontaneous mouse models for autoimmune diseases, generated through the crossing of animal (e.g., mouse) strains that have genetic susceptibility genes or loci followed by careful monitoring of the animals for the development of disease phenotype. Exemplary spontaneous animal models include the nonobese diabetic (NOD) mouse model, which spontaneously develops type 1 diabetes mellitus (T1D)-like phenotypes, and the NZB/W F1 mouse model, which spontaneously develops systemic lupus erythematosus (SLE)-like phenotypes. Another exemplary animal model of autoimmune disease includes the experimental autoimmune encephalomyelitis (EAE) mouse model, generated by autoantigen injection for the study of multiple sclerosis (MS). Exemplary rheumatoid arthritis (RA) models include human T-cell leukemia virus type I (HTLV-I) transgenic mouse models and IL-1 receptor antagonist (IL-1Ra) deficient (KO) mouse models. Concanavalin A (Con A)-induced hepatitis in the mouse is an exemplary model for autoimmune hepatitis (Tiegs et al., 1992, JCI, Mizuhara H., JEM, 1994, Toyabe S, JI, 1997). Other exemplary animal models include graft versus host-disease (GVHD) mouse model, syngeneic transplant mouse models, and bone marrow transplant models. Animal models are widely used to study pathology and treatment of autoimmune disease and can be used to assess the use, dosage, and efficacy of the variant CTLA4 polypeptides provided herein.

V. PHARMACEUTICAL FORMULATIONS

Provided herein are compositions containing any of the variant CTLA-4 polypeptides, immunomodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant CTLA-4 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, 1×10, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL.

Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 μg of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 μg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g., T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VI. ARTICLES OF MANUFACTURE AND KITS

Also provided herein are articles of manufacture, comprising the pharmaceutical compositions described herein in suitable packaging. Suitable packaging for compositions described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. THERAPEUTIC APPLICATIONS

The pharmaceutical compositions described herein (including pharmaceutical composition comprising the variant CTLA-4 polypeptides, the immunomodulatory proteins, the conjugates, and the engineered cells described herein) can be used in a variety of therapeutic applications, such as the treatment of a disease. For example, in some embodiments the pharmaceutical composition is used to treat inflammatory or autoimmune disorders, organ transplantation, cancer, viral infections, and/or bacterial infections in a mammal. The pharmaceutical composition can modulate an immune response to treat the disease.

Such methods and uses include therapeutic methods and uses, for example, involving administration of the molecules or engineered cells, or compositions containing the same, to a subject having a disease, condition, or disorder, such as a tumor or cancer. In some embodiments, the molecule ore engineered cell is administered in an effective amount to effect treatment of the disease or disorder. Uses include uses of molecules containing a variant CTLA-4 polypeptide, immunomodulatory protein, conjugate, engineered cell and infectious agentsin such methods and treatments, and in the preparation of a medicament in order to carry out such therapeutic methods. In some embodiments, the methods are carried out by administering a variant CTLA-4 polypeptide, immunomodulatory protein, conjugate, engineered cell, and infectious agent, or compositions comprising the same, to the subject having or suspected of having the disease or condition. In some embodiments, the methods thereby treat the disease or condition or disorder in the subject.

In some embodiments, the provided methods are applicable to therapeutic administration of variant CTLA-4 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g., decrease or increase that is desired.

In some embodiments, a pharmaceutical composition provided herein that inhibits or attenuates the immune response is administered, which can be useful, for example, in the treatment, prevention, or attenuation of autoimmune disease, inflammation, graft rejection, or organ transplant rejection. In some embodiments, the pharmaceutical composition contains a variant CTLA-4 polypeptide in a format that exhibits antagonist activity of a costimulatory receptor by blocking its interaction with its costimulatory ligand, ICOSL, CD80 and/or CD86, and/or that inhibits signaling via CD28 and/or ICOS. Exemplary formats of CTLA-4 polypeptides for use in connection with such therapeutic applications include, for example, a variant CTLA-4 polypeptide that is soluble (e.g. variant CTLA-4-Fc fusion protein), an immunomodulatory protein or "stack" of a variant CTLA-4 polypeptide and another IgSF domain, including soluble forms thereof that are Fc fusions, certain conjugates thereof, an engineered cell expressing a variant CTLA-4 capable of mediating transendocytosis, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g., T cell).

In some embodiments, the pharmaceutical composition can be used to suppress an immune response, and, for example, inhibit inflammation, graft rejection, organ transplant rejection, or attenuate or treat an autoimmune disease or disorder. A method of treating inflammation or autoimmune disease or disorders can include administering an effective amount of any of the pharmaceutical compositions described herein to a subject with inflammation or autoimmune disease. The effective amount of the pharmaceutical composition can be administered to inhibit, halt, or reverse progression of autoimmune disease or disorders, including autoimmune disease or disorders that are sensitive to modulation of immunological activity, such as by the provided variants or immunomodulatory proteins. Human immune cells can be treated in vivo, or ex vivo. In ex vivo treatment of a human patient, tissue or fluids containing immune cells are treated outside the body and then the tissue or fluids are reintroduced back into the patient. In some embodiments, the inflammation or autoimmune disease or disorder is treated in a human patient in vivo by administration of the therapeutic composition into the patient. Thus, the present invention provides ex vivo and in vivo methods to inhibit, halt, or reverse progression of the inflammation or autoimmune disease or disorder, or otherwise result in a statistically significant decrease in immunoactivity relative to treatment with a control.

The inflammatory and autoimmune disorders that can be treated by the pharmaceutical compositions and the treatment methods described herein include, but are not limited to, Addison's Disease, allergies, alopecia areata, Alzheimer's, antineutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barré syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Mënière's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, pemphigus foliaceus, pemphigus vulgaris, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

In some embodiments, the pharmaceutical composition is administered as a monotherapy (i.e., as a single agent) or as a combination therapy (i.e., in combination with one or more additional immunosuppressant agents). In some embodiments, the additional agent is a glucocorticoid (e.g., prednisone, dexamethasone, and hydrocortisone), cytostatic agent, such as a cytostatic agent that affect proliferation of T cells and/or B cells (e.g., purine analogs, alkylating agents, or antimetabolites), an antibody (e.g., anti-CD20, anti-CD25 or anti-CD3 monoclonal antibodies), cyclosporine, tacrolimus, sirolimus, everolimus, an interferon, an opiod, a TNF binding protein, mycophenolate, small biological agent, such as fingolimod or myriocin, cytokine, such as interferon beta-1a, an integrin agonist, or an integrin antagonist.

In some embodiments, a pharmaceutical composition provided herein that stimulates the immune response is administered, which can be useful, for example, in the treatment of cancer, viral infections, or bacterial infections. In some embodiments, the pharmaceutical composition contains a variant CTLA-4 polypeptide in a format that exhibits activity to promote and/or potentiate an activating signal in a T cell. An exemplary format for use in connection with such therapeutic applications include, for example, an engineered cell expressing a. CTLA-4 switch receptor in which a variant CTLA4 is expressed on engineered T cell with an ITAM-containing cytoplasmic domain, which turns the inhibitory receptor into an activating receptor. Another format for use in connection with such therapeutic applications include, for example, an engineered cell expressing a variant CTLA-4 polypeptide as a decoy receptor lacking a cytoplasmic signaling domain and/or that is not capable of mediating signaling, such as ITIM-mediated signaling, in the T cell.

In some embodiments, the pharmaceutical composition, such as one that stimulates an immune response, can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers, including cancers that are sensitive to modulation of immunological activity, such as by the provided variants or immunomodulatory proteins. Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient. Thus, the present invention provides ex vivo and in vivo methods to inhibit, halt, or reverse progression of the tumor, or otherwise result in a statistically significant increase in progression-free survival (i.e., the length of time during and after treatment in which a patient is living with cancer that does not get worse), or overall survival (also called "survival rate;" i.e., the percentage of people in a study or treatment group who are alive for a certain period of time after they were diagnosed with or treated for cancer) relative to treatment with a control.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects of the present disclosure, the immune checkpoint inhibitor is nivolumab, tremelimumab, pembrolizumab, ipilimumab, or the like.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as T-cells (including CD8+ or CD4+ T-cells) or APCs) are engineered to express as a membrane protein and/or as a soluble variant CTLA-4 polypeptide, immunomodulatory protein, or conjugate as described herein. The engineered cells can then be contact a mammalian cell, such as an APC, a second lymphocyte or tumor cell in which modulation of immunological activity is desired under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant CTLA-4 polypeptide, immunomodulatory protein, or conjugate as described herein), expanded in an in vitro culture system (for example, by stimulating the cells), and reinfused into the patient to mediate tumor destruction. In some embodiments, the method is conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

VIII. EXEMPLARY EMBODIMENTS

Among the provided embodiments are:

1. A variant CTLA-4 polypeptide, comprising an IgV domain or a specific binding fragment thereof, wherein the variant CTLA-4 polypeptide comprises one or more amino acid modifications in an unmodified CTLA-4 polypeptide or a specific binding fragment thereof, wherein the variant CTLA-4 polypeptide specifically binds to the ectodomain of ICOSL with increased affinity compared to the unmodified CTLA-4.

2. The variant CTLA-4 polypeptide of embodiment 1, wherein the variant CTLA-4 polypeptide comprises one or more amino acid modifications in the unmodified CTLA-4 polypeptide or a specific binding fragment thereof corresponding to position(s) selected from among 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, and 122 with reference to positions set forth in SEQ ID NO:2.

3. A variant CTLA-4 polypeptide, comprising an IgV domain or a specific binding fragment thereof, wherein the variant CTLA-4 polypeptide comprises one or more amino acid modifications in an unmodified CTLA-4 polypeptide or a specific binding fragment thereof corresponding to position(s) selected from among 6, 10, 12, 14, 15, 16, 18, 19, 20, 22, 24, 26, 27, 28, 29, 30, 33, 35, 37, 38, 41, 42, 43, 45, 46, 47, 48, 53, 54, 55, 56, 58, 59, 61, 63, 64, 65, 67 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, and 122 with reference to positions set forth in SEQ ID NO:2.

4. The variant CTLA-4 polypeptide of any of embodiments 1-3, wherein the amino acid modifications comprise amino acid substitutions, deletions or insertions.

5. The variant CTLA-4 polypeptide of any of embodiments 1-4, wherein the unmodified CTLA-4 polypeptide is a mammalian CTLA-4 polypeptide or a specific binding fragment thereof.

6. The variant CTLA-4 polypeptide of embodiment 5, wherein the unmodified CTLA-4 polypeptide is a human CTLA-4 polypeptide or a specific binding fragment thereof.

7. The variant CTLA-4 polypeptide of any of embodiments 1-6, wherein the variant CTLA-4 polypeptide comprises the extracellular domain of a human CTLA-4, wherein the one or more amino acid modifications are in one or more residues of the extracellular domain of the unmodified CTLA-4 polypeptide.

8. The variant CTLA-4 polypeptide of any of embodiments 1-7, wherein the unmodified CTLA-4 polypeptide comprises (i) the sequence of amino acids set forth in SEQ ID NO:2, (ii) a sequence of amino acids that has at least 95% sequence identity to SEQ ID NO:2; or (iii) a portion thereof comprising an IgV domain or specific binding fragment of the IgV domain.

9. The variant CTLA-4 polypeptide of any of embodiments 1-8, wherein the unmodified CTLA-4 comprises the sequence of amino acids set forth in SEQ ID NO:2.

10. The variant CTLA-4 polypeptide of any of embodiments 1-8, wherein:

the specific binding fragment of the IgV domain has a length of at least 50, 60, 70, 80, 90, 100, 110 or more amino acids; or the specific binding fragment of the IgV domain comprises a length that is at least 80% of the length of the IgV domain set forth as residues 39-140 of SEQ ID NO:1.

11. The variant CTLA-4 polypeptide of any of embodiments 1-10, wherein the variant CTLA-4 comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.

12. The variant CTLA-4 polypeptide of any of embodiments 1-11, wherein the variant CTLA-4 polypeptide comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:2 or a specific binding fragment thereof.

13. The variant CTLA-4 polypeptide of any of embodiments 3-12, wherein the variant CTLA-4 polypeptide specifically binds to the ectodomain of ICOSL, CD80 and/or CD86 with increased affinity compared to the binding of the unmodified CTLA-4 polypeptide for the same ectodomain(s).

14. A variant CTLA-4 polypeptide, comprising one or more amino acid modifications in the extracellular domain of a human CTLA-4 set forth in SEQ ID NO:2, wherein the variant CTLA-4 polypeptide specifically binds to the ectodomain of human ICOSL, CD80 and/or CD86 with increased affinity compared to the CTLA-4 comprising the extracellular domain set forth in SEQ ID NO:2.

15. The variant CTLA-4 polypeptide of any of embodiments 1-14, wherein the one or more amino acid modifications are selected from A6T, V10A, L12F, L12H, L12I, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V961, E97Q, L98Q, L98R, M991, M99L, P102L, Y105F, Y105L, L106I, L106N, L106R, L106V, I108F, I108V, N110K, N110S, N110Y, Q113H, Y115H, Y115N, V116A, I117E, I117L, I117M, I117T and P121S, or a conservative amino acid substitution thereof.

16. The variant CTLA-4 polypeptide of any of embodiments 1-15, comprising one or more amino acid modifications selected from among A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99L/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V, M56V/E59G/L63P/S72G/M87K/I93V/L98Q/M99L/Y105L/I117E, T61A/L63P/S72G/L98Q/M99L/Y105L, L63P, L63P/T69A/L98Q/M99L/Y105L/L106R/

V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, S72G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, L98R/N110K, T89A/L98Q/M99L/Y105L/L106I/Y115N/E120D/C122P/D124P/S125I/D126P, N58S/L63P/T71A/S72G/L98Q/M99L/Y105L/D124I/S125P/D126T, R16G/E33M/N58S/E59G/L63P/L98Q/Y105L/E120D/C122P/D124P/S125I/D126P, G29W/L63P/S72G/L98Q/Y105L/P121S/D126T, L12H/E33M/L98Q/Y105L, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/L98Q, T53S/M56K/N58S/L63P/M87V/Y105L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/Y105L, E33V/M99L/Y105L, E33V/L98Q/M99L, E33V/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L, M56T/L98Q/Y105L, L12F/R16H/G29W/M56T/S72G/L98Q/Y105L, G29W/M56T/S72G/L98Q/Y105L, and I18T/T61R/L63P/S72G/L98Q/M99L/P102L/Y105L.

17. The variant CTLA-4 polypeptide of any of embodiments 1-16, comprising the sequence of amino acids set forth in any of SEQ ID NOS: 4-97, 99-104, 106-155 or 570-637 or a specific binding fragment thereof, or a sequence of amino acids that exhibits at least 95% sequence identity to any of SEQ ID NOS: 4-97, 99-104, 106-155 or 570-637 or a specific binding fragment thereof, and that contains the one or more of the amino acid modifications.

18. The variant CTLA-4 polypeptide of any of embodiments 3-17, wherein the variant CTLA-4 polypeptide specifically binds to the ectodomain of ICOSL with increased affinity compared to the binding of the unmodified CTLA-4 for the same ectodomain.

19. The variant CTLA-4 polypeptide of any of embodiments 1-18, wherein the one or more amino acid modifications are at a position corresponding to position(s) selected from among 10, 12, 16, 18, 19, 26, 28, 29, 33, 35, 38, 42, 45, 47, 53, 55, 56, 58, 61, 63, 64, 65, 67, 69, 72, 76, 82, 85, 87, 89, 93, 97, 98, 99, 105, 106, 108, 110, 113, 116, 117 or 121, with reference to positions set forth in SEQ ID NO:2.

20. The variant CTLA-4 polypeptide of any of embodiments 1-19, wherein the one or more amino acid modifications are selected from among V10A, L12F, L12I, L12P, R16H, I18F, I18N, I18T, I18V, A19V, A26T, P28L, G29W, E33M, E33V, R35K, V38I, A42V, Q45H, T47A, T53S, M55T, M56K, M56T, M56V, N58D, N58S, T61A, T61R, L63H, L63P, D64E, D64N, D64V, D65G, I67N, I67T, I67V, T69A, T69I, S72G, Q76R, Q82H, Q82R, R85G, M87K, M87T, M87V, T89A, T89S, I93L, I93V, E97Q, L98Q, M99I, M99L, Y105L, L106I, L106R, I108F, I108V, N110K, Q113H, V116A, I117L and P121S.

21. The variant CTLA-4 polypeptide of any of embodiments 1-19, wherein the one or more amino acid modifications are selected from V10A, L12F, L12I, R16H, I18N, I18T, I18V, A19V, A26T, G29W, E33M, E33V, R35K, V38I, A42V, Q45H, T47A, T53S, M55T, M56K, M56V, N58D, N58S, T61A, T61R, L63H, L63P, D64E, D64N, D64V, D65G, I67N, I67T, I67V, T69I, S72G, Q76R, Q82H, Q82R, R85G, M87K, M87T, M87V, T89A, T89S, I93L, I93V, E97Q, L98Q, M99I, M99L, Y105L, L106I, L106R, I108F, I108V, N110K, Q113H, I117L, and P121S, or a conservative amino acid substitution thereof.

22. The variant CTLA-4 polypeptide of any of embodiments 1-21, wherein the one or more amino acid modifications are L63P/S72G/L98Q/M99L/Y105L/L106I/I117L, G29W/L98Q/M99L/Y105L, M55T/S72G/L98Q/M99L/Y105L, L63P/Q82H/L98Q/M99L/Y105L, I18T/L63P/S72G/L98Q/M99L/Y105L, T61A/L63P/S72G/L98Q/M99L/Y105L, V38I/L63P/S72G/L98Q/M99L/Y105L, L63P/S72G/I93L/L98Q/M99L/Y105L, L12I/M55T/M56V/I67T/M99L/L106R/I108F, I18N/A26T/L63H/T89A/L98Q/M99L/Y105L, G29W/N58S/L63P/M87T/L98Q/M99L/Y105L, G29W/N58S/L63P/D64N/L98Q/M99L/Y105L, I18T/L63P/S72G/M87K/L98Q/M99L/Y105L, L63P/M87K/M99L/L106R, L63P/M99L/Y105L/I108F, G29W/L63P/L98Q/M99L/Y105L, A26T/L63P/D65G/L98Q/M99L/Y105L, V10A/L63P/D64V/S72G/L98Q/M99L/Y105L, I18V/A26T/L63P/D64E/L98Q/Y105L/L106R/N110K, A19V/G29W/R35K/L63P/L98Q/M99L/Y105L, G29W/N58S/L63P/T69I/L98Q/M99L/Y105L, G29W/T53S/M56K/L63P/L98Q/Y105L, L12F/R16H/G29W/M56T/L98Q/Y105L, A26T/T53S/L63P/L98Q/Y105L/L106I/I117L, G29W/S72G/Q76R/L98Q/Y105L/L106I/Q113H, G29W/N58D/I67V/L98Q/M99L/Y105L, I67V/S72G/Q82H/T89A/L98Q/M99L/Y105L, S72G/R85G/L98Q/M99L/Y105L/L106I, A26T/T47A/M56K/L63P/S72G/Q82R/L98Q/M99L/Y105L, A26T/M55T/L63P/S72G/L98Q/M99L/Y105L, G29W/M87K/I93V/L98Q/M99L/Y105L, G29W/T53S/M56K/L63P/Q82H/L98Q/M99L/Y105L, L63P/L98Q/M99L/Y105L/I108V, A26T/A42V/Q45H/I67N/M87K/E97Q/M99L, E33M/L63P/S72G/L98Q/Y105L, G29W/M87K/T89S/L98Q/M99L/Y105L/I108V/I117L, I18T/T61R/L63P/S72G/L98Q/M99L/Y105L, E33M/L63P/S72G/L98Q/Y105L/I108F, G29W/T53S/M56K/N58S/L63P/M87V/L98Q/Y105L/P121S, G29W/T53S/M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/M87V/L98Q, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L, L12F/R16H/G29W/M56T/Y105L or L12F/L98Q/Y105L. In some embodiments, the amino acid substitutions are G29W/L98Q/M99L/Y105L, L63P/M99L/Y105L/I108F, I18V/A26T/L63P/D64E/L98Q/Y105L/L106R/N110K, G29W/N58D/I67V/L98Q/M99L/Y105L, I67V/S72G/Q82H/T89A/L98Q/M99L/Y105L, S72G/R85G/L98Q/M99L/Y105L/L106I, G29W/M87K/I93V/L98Q/M99L/Y105L, G29W/T53S/M56K/L63P/Q82H/L98Q/M99L/Y105L, A26T/A42V/Q45H/I67N/M87K/E97Q/M99L, G29W/M87K/T89S/L98Q/M99L/Y105L/I108V/I117L, G29W/T53S/

M56K/N58S/L63P/M87V/L98Q/Y105L/I108V, T53S/M56K/N58S/L63P/M87V/L98Q/Y105L, I18T/A26T/M55T/M56K/L63P/L98Q/M99L/Y105L, I18T/A26T/M56K/L63P/L98Q/Y105L, T53S/L63P/L98Q, T53S/L63P/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L or L12F/L98Q/Y105L.

23. The variant CTLA-4 polypeptide of any of embodiments 1-20, wherein the one or more amino acid modifications comprise one or more modifications at a position corresponding to position(s) 12, 26, 63, 98 or 105 and/or the one or more amino acid modifications comprise one or more modifications selected from L12P, L12F, A26T, L63P, L98Q or Y105L.

24. The variant CTLA-4 polypeptide of any of embodiments 1-23, comprising one or more amino acid modifications selected from among L12P/A26T/L63P/L98Q/Y105L; A26T/L63P/S72G/L98Q/M99L/Y105L; M55T/S72G/L98Q/M99L/Y105L; L63P/Q82H/L98Q/M99L/Y105L; I18T/L63P/S72G/L98Q/M99L/Y105L; T61A/L63P/S72G/L98Q/M99L/Y105L; V38I/L63P/S72G/L98Q/M99L/Y105L; L63P/S72G/I93L/L98Q/M99L/Y105L; L12I/M55T/M56V/I67T/M99L/L106R/I108F; I18N/A26T/L63H/T89A/L98Q/M99L/Y105L; G29W/N58S/L63P/M87T/L98Q/M99L/Y105L; G29W/N58S/L63P/D64N/L98Q/M99L/Y105L; I18T/L63P/S72G/M87K/L98Q/M99L/Y105L; L63P/M87K/M99L/L106R; L63P/M99L/Y105L/I108F; G29W/L63P/L98Q/M99L/Y105L; A26T/L63P/D65G/L98Q/M99L/Y105L; V10A/L63P/D64V/S72G/L98Q/M99L/Y105L; I18V/A26T/L63P/D64E/L98Q/Y105L/L106R/N110K; A19V/G29W/R35K/L63P/L98Q/M99L/Y105L; G29W/N58S/L63P/T69I/L98Q/M99L/Y105L; L63P/T69A/L98Q/M99L/Y105L/L106R/V116A; G29W/T53S/M56K/L63P/L98Q/Y105L; G29W/L63P/S72G/L98Q/Y105L/I117L; L63P/S72G/L98Q/Y105L/L106I/I117L; L12F/R16H/G29W/M56T/L98Q/Y105L; A26T/T53S/L63P/L98Q/Y105L/L106I/I117L; G29W/S72G/Q76R/L98Q/Y105L/L106I/Q113H; G29W/N58D/I67V/L98Q/M99L/Y105L; I67V/S72G/Q82H/T89A/L98Q/M99L/Y105L; S72G/R85G/L98Q/M99L/Y105L/L106I; A26T/T47A/M56K/L63P/S72G/Q82R/L98Q/M99L/Y105L; A26T/M55T/L63P/S72G/L98Q/M99L/Y105L; G29W/M87K/I93V/L98Q/M99L/Y105L; P28L/E33V/L63P/S72G/L98Q/M99L/Y105L; G29W/T53S/M56K/L63P/Q82H/L98Q/M99L/Y105L; I18F/L63P/L98Q/M99L/Y105L/P121S; L63P/L98Q/M99L/Y105L/I108V; A26T/A42V/Q45H/I67N/M87K/E97Q/M99L; E33M/L63P/S72G/L98Q/Y105L; G29W/M87K/T89S/L98Q/M99L/Y105L/I108V/I117L; I18T/T61R/L63P/S72G/L98Q/M99L/Y105L; E33M/L63P/S72G/L98Q/Y105L/I108F; G29W/T53S/M56K/N58S/L63P/M87V/L98Q/Y105L/P121S; G29W/T53S/M56K/N58S/L63P/M87V/L98Q/Y105L; and G29W/T53S/M56K/N58S/L63P/M87V/L98Q/Y105L/I108V.

25. The variant CTLA-4 polypeptide of any of embodiments 3-17, wherein the variant CTLA-4 polypeptide specifically binds to the ectodomain of CD80 with increased affinity compared to the binding of the unmodified CTLA-4 for the same ectodomain.

26. The variant CTLA-4 polypeptide of any of embodiments 3-17 and 25, wherein the one or more amino acid modifications are at a position corresponding to position(s) selected from among 10, 12, 16, 18, 26, 29, 42, 45, 53, 56, 58, 63, 67, 72, 82, 87, 97, 98, 99, 105, 108 or 121, with reference to positions set forth in SEQ ID NO:2.

27. The variant CTLA-4 polypeptide of any of embodiments 3-17, 25 and 26, wherein the one or more amino acid modifications are selected from V10A, L12F, R16H, I18T, A26T, G29W, E33V, A42V, Q45H, T53S, M55T, M56K, M56T, N58S, L63P, I67N, Q82R, M87K, M87V, E97Q, L98Q, M99L, Y105L, I108V, or a conservative amino acid substitution thereof.

28. The variant CTLA-4 polypeptide of any of embodiments 3-17, 25 and 26, wherein the one or more amino acid modifications are at a position corresponding to position(s) selected from among V10A, L12F, R16H, I18T, A26D, A26T, G29W, A42V, Q45H, T53S, M56K, M56T, N58S, L63P, I67N, S72G, Q82R, M87K, M87V, E97Q, L98Q, M99L, Y105L, I108V, or P121S, with reference to positions set forth in SEQ ID NO:2.

29. The variant CTLA-4 polypeptide of any of embodiments 3-17, and 25-28, wherein the one or more amino acid modifications are selected from among I18T/G29W/L63P/L98Q/Y105L; G29W/L63P/L98Q/M99L/Y105L; G29W/N58S/L63P/L98Q/Y105L; A26D/S72G/L98Q/M99L/Y105L; G29W/N58S/L63P/Q82R/L98Q/Y105L; L12F/R16H/G29W/M56T/L98Q/Y105L; A26T/A42V/Q45H/I67N/M87K/E97Q/M99L; G29W/T53S/M56K/N58S/L63P/M87V/L98Q/Y105L/P121S; G29W/T53S/M56K/N58S/L63P/M87V/L98Q/Y105L; G29W/T53S/M56K/N58S/L63P/M87V/L98Q/Y105L/I108V and V10A/G29W/T53S/M56K/L63P/L98Q/Y105L/P121S.

30. The variant CTLA-4 polypeptide of any of embodiments 3-17 and 25-28, wherein the one or more amino acid modifications are selected from among I18T/G29W/L63P/L98Q/Y105L, G29W/N58S/L63P/L98Q/Y105L, G29W/N58S/L63P/Q82R/L98Q/Y105L, L12F/R16H/G29W/M56T/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, V10A/G29W/T53S/M56K/L63P/L98Q/Y105L/P121S, T53S/M56K/N58S/L63P/M87V/L98Q/Y105L, I18T/A26T/M55T/M56K/L63P/L98Q/M99L/Y105L, T53S/M56K/N58S/L63P/M87V/Y105L, L98Q/M99L/Y105L, E33V/L98Q/Y105L, E33V/M99L, T53S/M56K/N58S/L63P/L98Q/Y105L, T53S/M56K/N58S/M87V/L98Q/Y105L, T53S/M56K/L63P/M87V/L98Q/Y105L, T53S/N58S/L63P/M87V/L98Q/Y105L, M56K/N58S/L63P/M87V/L98Q/Y105L, E33V/L98Q/M99L, L12F/R16H/G29W/M56T/L98Q, L12F/R16H/G29W/M56T/Y105L, L12F/R16H/G29W/L98Q/Y105L, L12F/R16H/M56T/L98Q/Y105L, G29W/M56T/L98Q/Y105L, L12F/G29W/L98Q/Y105L, L12F/L98Q/Y105L, R16H/L98Q/Y105L, G29W/L98Q/Y105L or M56T/L98Q/Y105L.

31. The variant CTLA-4 polypeptide of any of embodiments 3-17, 25-28 and 30, wherein the one or more amino acid modifications are selected from among I18T/G29W/L63P/L98Q/Y105L, G29W/N58S/L63P/L98Q/Y105L, G29W/N58S/L63P/Q82R/L98Q/Y105L, A26T/A42V/Q45H/I67N/M87K/E97Q/M99L, G29W/T53S/M56K/N58S/L63P/M87V/L98Q/Y105L/P121S, G29W/T53S/M56K/N58S/L63P/M87V/L98Q/Y105L, G29W/T53S/M56K/N58S/L63P/M87V/L98Q/Y105L/I108V, L98Q/M99L/Y105L, E33V/L98Q/Y105L, T53S/M56K/N58S/L63P/L98Q/Y105L, T53S/M56K/N58S/M87V/L98Q/Y105L and E33V/L98Q/M99L.

32. The variant CTLA-4 polypeptide of any of embodiments 1-29, wherein the variant CTLA-4 polypeptide specifically binds to the ectodomain of ICOSL and CD80 with increased affinity compared to the binding of the unmodified CTLA-4 for the same ectodomains.

33. The variant CTLA-4 polypeptide of any of embodiments 1-32, wherein the one or more amino acid modifications are selected from V10A, L12F, R16H, I18T, A26T, G29W, E33V, A42V, Q45H, T53S, M55T, M56K, N58S, L63P, I67N, Q82R, M87K, M87V, E97Q, L98Q, M99L, Y105L, I108V, or a conservative amino acid substitution thereof.

34. The variant CTLA-4 polypeptide of any of embodiments 1-33, wherein the one or more amino acid modifications are selected from I18T, A26T, G29W, E33V, Q45H, T53S, M56K, N58S, L63P, I67N, Q82R, M87K, M87V, E97Q, L98Q, M99L, Y105L, I108V.

35. The variant CTLA-4 polypeptide of any of embodiments 3-17, wherein the variant CTLA-4 polypeptide specifically binds to the ectodomain of CD86 with increased affinity compared to the binding of the unmodified CTLA-4 for the same ectodomain.

36. The variant CTLA-4 polypeptide of any of embodiments 3-17 and 35, wherein the one or more amino acid modifications are at a position corresponding to position(s) selected from among 10, 12, 16, 18, 20, 26, 28, 29, 30, 33, 42, 47, 53, 55, 56, 58, 59, 61, 63, 65, 67, 69, 72, 76, 82, 85, 87, 89, 93, 96, 98, 99, 102, 105, 106, 108, 113, 115, 116, 117 or 121, with reference to positions set forth in SEQ ID NO:2.

37. The variant CTLA-4 polypeptide of any of embodiments 3-17, 35 and 36, wherein the one or more amino acid modifications are at a position corresponding to position(s) selected from among V10A, L12F, L12H, L12P, R16H, I18T, I18V, S20N, A26S, A26T, P28L, G29R, G29W, K30R, E33M, E33V, A42S, A42T, T47A, T53S, M55T, M56K, M56R, M56T, M56V, N58D, N58S, E59G, T61I, T61N, T61R, T61S, L63P, D65G, I67N, I67V, T69A, T69I, S72G, Q76R, Q82H, Q82R, R85G, M87K, M87V, T89A, T89M, T89S, I93V, V961, L98Q, L98R, M99L, P102L, Y105L, L106I, L106N, L106R, L106V, I108F, I108V, Q113H, Y115H, V116A, I117E, I117L, I117K, I117T, and P121S, with reference to positions set forth in SEQ ID NO:2.

38. The variant CTLA-4 polypeptide of any of embodiments 3-17, 35 and 36, wherein the one or more amino acid modifications are selected from L12F, L12H, L12P, R16H, I18T, I18V, S20N, A26T, G29R, G29W, E33M, E33V, A42S, A42V, T47A, T53S, M55T, M56K, M56R, M56T, M56V, N58D, N58S, T61I, T61N, T61R, T61S, L63P, D65G, I67N, I67V, T69A, T69I, S72G, Q76R, Q82H, Q82R, R85G, M87K, M87V, T89A, T89M, T89S, V961, L98Q, L98R, M99L, P102L, Y105L, L106I, L106N, L106R, L106V, I108F, I108V, Q113H, Y115H, V116A, I117L, I117T and P121S, or a conservative amino acid substitution thereof.

39. The variant CTLA-4 polypeptide of any of embodiments 3-17, and 35-38, wherein the one or more amino acid modifications are selected from among L12P/A26T/L63P/L98Q/Y105L; I18T/T61R/L63P/S72G/L98Q/M99L/P102L/Y105L; L12P/A26T/L63P/S72G/T89M/L98Q/M99L/Y105L; P28L/E33V/L63P/S72G/L98R/M99L/Y105L; I18T/G29R/L63P/S72G/L98Q/M99L/Y105L; S72G/L98Q/M99L/Y105L/I117T; M56R/L63P/L98Q/M99L/Y105L; L63P/L98Q/M99L/Y105L/L106I; A26T/M55T/L63P/L98Q/M99L/Y105L; E33V/A42S/M55T/L98Q/M99L/Y105L; G29W/N58S/L63P/Q82R/L98Q/Y105L; E33M/L63P/S72G/L98Q/Y105L/I117L; A26T/I67N/S72G/L98Q/M99L/Y105L; L12F/A26T/L63P/L98Q/Y105L/L106R; S20N/A26T/L63P/L98Q/M99L/Y105L; G29W/T61I/L63P/S72G/L98Q/M99L/Y105L; G29W/N58S/L63P/T69I/L98Q/M99L/Y105L; L12P/L63P/S72G/L98Q/M99L/Y105L/L106N; L63P/T69A/L98Q/M99L/Y105L/L106R/V116A; G29W/N58S/L63P/S72G/L98Q/Y105L; G29W/L63P/D65G/S72G/L98Q/Y105L; T53S/M56V/L98Q/Y105L; L63P/S72G/L98Q/Y105L; G29W/T53S/M56K/L63P/L98Q/Y105L; I18V/G29W/L63P/S72G/L98Q/Y105L; G29W/L63P/S72G/L98Q/Y105L/L106I; G29W/L63P/I67V/S72G/L98Q/Y105L; L63P/S72G/L98Q/Y105L/L106I/I117L; L12F/R16H/G29W/M56T/L98Q/Y105L; L12P/G29W/L63P/S72G/L98Q/Y105L; G29W/N58S/L63P/S72G/M87V/L98Q/Y105L; G29W/S72G/Q76R/L98Q/Y105L/L106I/Q113H; G29W/N58S/L63P/S72G/L98Q/Y105L/L106V; A26T/L63P/L98Q/M99L/Y105L; G29W/N58D/I67V/L98Q/M99L/Y105L; I67V/S72G/Q82H/T89A/L98Q/M99L/Y105L; S72G/R85G/L98Q/M99L/Y105L/L106I; L63P/L98Q/M99L/Y105L; A26T/T47A/M56K/L63P/S72G/Q82R/L98Q/M99L/Y105L; A26T/M55T/L63P/S72G/L98Q/M99L/Y105L; L12H/I18V/A42T/M55T/N58D/L98R/Y105L/L106I/P121S; I18T/A26T/L63P/S72G/L98Q/Y105L; L12F/K30R/S72G/Q82R/L98Q/M99L/Y105L; L12P/L63P/S72G/L98Q/M99L/Y105L/L106N/I117L; G29W/M87K/I93V/L98Q/M99L/Y105L; P28L/E33V/L63P/S72G/L98Q/M99L/Y105L; E33M/L63P/S72G/L98Q/Y105L; M56V/E59G/L63P/S72G/M87K/I93V/L98Q/M99L/Y105L/I117E; G29W/M87K/T89S/L98Q/M99L/Y105L/I108V/I117L; L12P/M56V/L63P/V96I/L98Q/M99L/Y105L/Y115H; G29W/T53S/M56K/T61N/L63P/L98Q/Y105L; I18T/A26S/M55T/M56V/L63P/S72G/L98Q/M99L/Y105L/I117K; I18T/T61R/L63P/S72G/L98Q/M99L/Y105L; L12P/L63P/S72G/L98Q/M99L/Y105L; E33M/L63P/S72G/L98Q/Y105L/I108F; L12P/R16H/A26T/T61S/L63P/M87V/L98Q/M99L/Y105L/L106I/I117L G29W/T53S/M56K/N58S/L63P/M87V/L98Q/Y105L/P121S; G29W/L63P/S72G/L98Q/Y105L/P121S; and V10A/G29W/T53S/M56K/L63P/L98Q/Y105L/P121S.

40. The variant CTLA-4 polypeptide of any of embodiments 3-17, and 35-38, wherein the one or more amino acid modifications are selected from among I18T/T61R/L63P/S72G/L98Q/M99L/P102L/Y105L, L12P/A26T/L63P/S72G/T89M/L98Q/M99L/Y105L, I18T/G29R/L63P/S72G/L98Q/M99L/Y105L, S72G/L98Q/M99L/Y105L/I117T, M56R/L63P/L98Q/M99L/Y105L, L63P/L98Q/M99L/Y105L/L106I, A26T/M55T/L63P/L98Q/M99L/Y105L, E33V/A42S/M55T/L98Q/M99L/Y105L, G29W/N58S/L63P/Q82R/L98Q/Y105L, E33M/L63P/S72G/L98Q/Y105L/I117L, A26T/I67N/S72G/L98Q/M99L/Y105L, L12F/A26T/L63P/L98Q/Y105L/L106R, S20N/A26T/L63P/L98Q/M99L/Y105L, G29W/T61I/L63P/S72G/L98Q/M99L/Y105L, G29W/N58S/L63P/T69I/L98Q/M99L/Y105L, L12P/L63P/S72G/L98Q/M99L/Y105L/L106N, L63P/T69A/L98Q/M99L/Y105L/L106R/V116A, G29W/N58S/L63P/S72G/L98Q/Y105L, G29W/L63P/D65G/S72G/L98Q/Y105L, T53S/M56V/L98Q/Y105L, L63P/S72G/L98Q/Y105L, G29W/L63P/S72G/L98Q/Y105L/L106I, L12F/R16H/G29W/M56T/L98Q/Y105L, G29W/N58S/L63P/S72G/M87V/L98Q/Y105L, G29W/S72G/Q76R/L98Q/Y105L/L106I/Q113H, G29W/N58S/L63P/S72G/L98Q/Y105L/L106V, G29W/N58D/I67V/L98Q/M99L/Y105L, I67V/S72G/Q82H/T89A/L98Q/M99L/Y105L, S72G/R85G/L98Q/M99L/Y105L/L106I, L63P/L98Q/M99L/Y105L, A26T/T47A/M56K/L63P/S72G/Q82R/L98Q/M99L/Y105L, A26T/M55T/L63P/S72G/L98Q/M99L/Y105L, L12H/I18V/A42T/M55T/N58D/L98R/Y105L/L106I/P121S, E33M/L63P/S72G/L98Q/Y105L, G29W/M87K/T89S/L98Q/M99L/Y105L/I108V/I117L, L12P/M56V/L63P/V96I/L98Q/M99L/Y105L/

Y115H, G29W/T53S/M56K/T61N/L63P/L98Q/Y105L, I18T/T61R/L63P/S72G/L98Q/M99L/Y105L, L12P/L63P/S72G/L98Q/M99L/Y105L, E33M/L63P/S72G/L98Q/Y105L/I108F, L12P/R16H/A26T/T61S/L63P/M87V/L98Q/M99L/Y105L/L106I/I117L, L98Q/M99L/Y105L, T53S/M56K/N58S/M87V/L98Q/Y105L, L12F/R16H/G29W/M56T/L98Q, L12F/G29W/L98Q/Y105L or L12F/L98Q/Y105L.

41. The variant CTLA-4 polypeptide of any of embodiments 3-17 and 25-40, wherein the variant CTLA-4 polypeptide specifically binds to the ectodomain of CD80 and CD86 with increased affinity compared to the binding of the unmodified CTLA-4 for the same ectodomains.

42. The variant CTLA-4 polypeptide of any of embodiments 3-17 and 25-41, wherein the one or more amino acid modifications are selected from I18T, A26T, G29W, E33V, A42V, T53S, N58S, L63P, I67N, Q82R, M87K, M87V, L98Q, M99L, Y105L, I108V.

43. The variant CTLA-4 polypeptide of any of embodiments 1-24 and 35-40, wherein the variant CTLA-4 polypeptide specifically binds to the ectodomain of ICOSL and CD86 with increased affinity compared to the binding of the unmodified CTLA-4 for the same ectodomains.

44. The variant CTLA-4 polypeptide of any of embodiments 1-24 and 35-40 and 43, wherein the one or more amino acid modifications are selected from L12F, R16H, I18T, I18V, A26T, G29W, E33M, E33V, A42V, T47A, T53S, M55T, M56K, M56V, N58D, N58S, T61R, L63P, D65G, I67N, I67V, T69I, S72G, Q76R, Q82H, Q82R, R85G, M87K, M87V, T89A, T89S, L98Q, M99L, Y105L, L106I, L106R, I108F, I108V, Q113H, I117L, and P121S, or a conservative amino acid substitution thereof.

45. The variant CTLA-4 polypeptide of any of embodiments 1-24 and 35-40, 43 and 44, wherein the one or more amino acid modifications are selected from L12F, R16H, I18T, I18V, A26T, G29W, E33V, A42V, T47A, T53S, M55T, M56K, N58D, N58S, L63P, I67N, I67V, S72G, Q82H, Q82R, R85G, M87K, M87V, T89A, T89S, L98Q, M99L, Y105L, L106I, L106R, I108F, I108V, and I117L.

46. The variant CTLA-4 polypeptide of any of embodiments 1-43, wherein the variant CTLA-4 polypeptide specifically binds to the ectodomain of ICOSL, CD80, and CD86 with increased affinity compared to the binding of the unmodified CTLA-4 for the same ectodomains.

47. The variant CTLA-4 polypeptide of any of embodiments 1-46, wherein the one or more amino acid modifications are selected from L12F, R16H, I18T, A26T, G29W, E33V, A42V, T53S, M55T, M56K, N58S, L63P, I67N, Q82R, M87K, M87V, L98Q, M99L, Y105L or I108V.

48. The variant CTLA-4 polypeptide of any of embodiments 1-47, wherein the one or more amino acid modifications are selected from A26T, G29W, T53S, M56K, N58S, L63P, L98Q, M99L or Y105L.

49. The variant CTLA-4 polypeptide of any of embodiments 1-48, wherein the one or more amino acid modifications are selected from, G29W, L63P, L98Q, M99L or Y105L.

50. The variant CTLA-4 polypeptide of any of embodiments 1-49, wherein the one or more amino acid modifications comprise modifications selected from G29W/L63P, G29W/L98Q, G29W/M99L, G29W/Y105L, L63P/L98Q, L63P/M99L, L63P/Y105L, L98Q/M99L, L98Q/Y105L or M99L/Y105L.

51. The variant CTLA-4 polypeptide of any of embodiments 1-50, wherein the amino acid modifications are G29W/L98Q/Y105L.

52. The variant CTLA-4 polypeptide of any of embodiments 1-51, wherein the amino acid modifications are G29W/N58S/L63P/Q82R/L98Q/Y105L.

53. The variant CTLA-4 polypeptide of any of embodiments 1-51, wherein the amino acid modifications are L12P/G29W/L63P/S72G/L98Q/Y105L.

54. The variant CTLA-4 polypeptide of any of embodiments 3-24, wherein the variant CTLA-4 polypeptide specifically binds to the ectodomain of ICOSL with increased affinity and specifically binds to the ectodomain of one or more of the other of CD80 or CD86 with decreased affinity compared to the binding of the unmodified CTLA-4 for the same ectodomains.

55. The variant CTLA-4 polypeptide of any of embodiments 1 and 13-54, wherein the increase in binding affinity for the one or more ectodomain is, independently, more than 1.2-fold, 1.5-fold, 2-fold, 3-fold, 4-fold, 5-fold, 6-fold, 7-fold, 8-fold, 9-fold, 10-fold, 20-fold, 30-fold 40-fold, 50-fold, 100-fold or more.

56. The variant CTLA-4 polypeptide of embodiment 54, wherein the decrease in binding affinity for the one or more ectodomain is, independently, more than 1.2-fold, 1.5-fold, 2-fold, 3-fold, 4-fold, 5-fold, 6-fold, 7-fold, 8-fold, 9-fold, 10-fold, 20-fold, 30-fold 40-fold, 50-fold, 100-fold or more.

57. The variant CTLA-4 polypeptide of any of embodiments 1-56, wherein the variant CTLA-4 polypeptide comprises the IgV domain or a specific binding fragment thereof.

58. The variant CTLA-4 polypeptide of embodiment 57, wherein the IgV domain or specific binding fragment thereof is the only CTLA-4 portion of the variant CTLA-4 polypeptide.

59. The variant CTLA-4 polypeptide of any of embodiments 1-58, comprising the sequence of amino acids set forth in any of SEQ ID NOS: 156-285, 603-635 or 637 or a specific binding fragment thereof, a sequence of amino acids that exhibits at least 95% sequence identity to any of SEQ ID NOS: 156-285, 603-635 or 637 or a specific binding fragment thereof and that contains the one or more of the amino acid modifications of the respective SEQ ID NO set forth in any of SEQ ID NOS: 156-285, 603-635 or 637.

60. The variant CTLA-4 polypeptide of any of embodiments 1-57 or 59, comprising the sequence of amino acids of the extracellular domain set forth in any of SEQ ID NOS: 4-97, 99-104, 106-155, 569-602 or 636, or a specific binding fragment thereof, or a sequence of amino acids that exhibits at least 95% sequence identity to any of SEQ ID NOS: 4-97, 99-104, 106-155, 569-602 or 63, and that contains the one or more of the amino acid modifications of the respective SEQ ID NO set forth in any of SEQ ID NOS: 4-97, 99-104, 106-155, 569-602 or 636.

61. The variant CTLA-4 polypeptide of any of embodiments 1 and 13-59, wherein the ICOSL is a human ICOSL.

62. The variant CTLA-4 polypeptide of any of embodiments 13-59, wherein the CD80 is a human CD80.

63. The variant CTLA-4 polypeptide of any of embodiments 13-59, wherein the CD86 is a human CD86.

64. The variant CTLA-4 polypeptide of any of embodiments 1-63 that is a soluble protein.

65. The variant CTLA-4 polypeptide of any of embodiments 1-64, wherein:

the variant CTLA-4 polypeptide lacks the CTLA-4 transmembrane domain and intracellular signaling domain; and/or the variant CTLA-4 polypeptide is not capable of being expressed on the surface of a cell.

66. The variant CTLA-4 polypeptide of any of embodiments 1-65 that is linked to a multimerization domain.

67. The variant CTLA-4 polypeptide of embodiment 66, wherein the multimerization domain is an Fc domain or a variant thereof with reduced effector function.

68. The variant CTLA-4 polypeptide of any of embodiments 1-67 that is linked to an Fc domain or a variant thereof with reduced effector function.

69. The variant CTLA-4 polypeptide of embodiment 67 or embodiment 68, wherein:

the Fc domain is mammalian, optionally human; or the variant Fc domain comprises one or more amino acid modifications compared to an unmodified Fc domain that is mammalian, optionally human.

70. The variant CTLA-4 polypeptide of any of embodiments 67-69, wherein the Fc domain or variant thereof comprises the sequence of amino acids set forth in any of SEQ ID NOs:438-442 or a sequence of amino acids that exhibits at least 85% sequence identity to any of SEQ ID NOs:438-442.

71. The variant CTLA-4 polypeptide of any of embodiments 67-70, wherein the Fc domain comprises one or more amino acid modifications selected from among E233P, L234A, L234V, L235A, L235E, G236del, G237A, S267K, N297G, V302C and K447del, each by EU numbering.

72. The variant CTLA-4 polypeptide of any of embodiments 67-71, wherein the Fc domain comprises the amino acid modifications L234A/L235E/G237A.

73. The variant CTLA-4 polypeptide of any of embodiments 67-72, wherein the Fc domain comprises the amino acid modification C220S by EU numbering.

74. The variant CTLA-4 polypeptide of any of embodiments 67-73, wherein the variant CTLA-4 polypeptide is linked to the multimerization domain or Fc indirectly via a linker, optionally a G4S linker.

75. The variant CTLA-4 polypeptide of any of embodiments 67-74, comprising the sequence of amino acids set forth in any of SEQ ID NOs: 286-379, 381-386, or 388-437 or a sequence of amino acids that exhibits at least 85% sequence identity to any of SEQ ID NOs: 286-379, 381-386, or 388-437.

76. The variant CTLA-4 polypeptide of any of embodiments 1-63, wherein the variant CTLA-4 polypeptide is a transmembrane immunomodulatory protein further comprising a transmembrane domain, optionally wherein the transmembrane domain is linked, directly or indirectly, to the extracellular domain (ECD) or specific binding fragment thereof of the variant CTLA-4 polypeptide.

77. The variant CTLA-4 polypeptide of embodiment 76, wherein the transmembrane domain comprises the sequence of amino acids set forth as residues 162-182 of SEQ ID NO:1 or a functional variant thereof that exhibits at least 85% sequence identity to residues 162-182 of SEQ ID NO:1.

78. The variant CTLA-4 polypeptide of embodiment 76 or embodiment 77, further comprising a cytoplasmic domain, optionally wherein the cytoplasmic domain is linked, directly or indirectly, to the transmembrane domain.

79. The variant CTLA-4 polypeptide of embodiment 78, wherein the cytoplasmic domain is or comprises a native CTLA-4 cytoplasmic domain, an intracellular signaling domain, and/or comprises an ITIM signaling motif.

80. The variant CTLA-4 polypeptide of embodiment 78 or embodiment 79, wherein the cytoplasmic domain comprises the sequence of amino acids set forth as residues 183-223 of SEQ ID NO:1 or a functional variant thereof that exhibits at least 85% sequence identity to residues 183-223 of SEQ ID NO:1.

81. The variant CTLA-4 polypeptide of embodiment 78, wherein the cytoplasmic domain comprises an ITAM signaling motif and/or is or comprises an intracellular signaling domain of CD3 zeta.

82. The variant CTLA-4 polypeptide of embodiment 76 or embodiment 77, wherein the polypeptide does not comprise a cytoplasmic signaling domain and/or is not capable of mediating or modulating an intracellular signal when expressed on a cell.

83. The variant CTLA-4 polypeptide of any of embodiments 1-82, wherein the variant CTLA-4 polypeptide decreases IFN-gamma (interferon-gamma) expression relative to the unmodified CTLA-4 polypeptide in an in vitro primary T-cell assay.

84. The variant CTLA-4 polypeptide of any of embodiments 1-83 that is deglycosylated.

85. An immunomodulatory polypeptide, comprising the variant CTLA-4 of any of embodiments 1-84 linked, directly or indirectly via a linker, to a second polypeptide comprising an immunoglobulin superfamily (IgSF) domain of an IgSF member.

86. The immunomodulatory protein of embodiment 85, wherein the IgSF domain is an affinity-modified IgSF domain, said affinity-modified IgSF domain comprising one or more amino acid modifications compared to the unmodified or wild-type IgSF domain of the IgSF family member.

87. The immunomodulatory polypeptide of embodiment 86, wherein the affinity-modified IgSF domain exhibits altered binding to one or more of its cognate binding partner(s) compared to the binding of the unmodified or wild-type IgSF domain of the IgSF family member to the same one or more cognate binding partner(s).

88. The immunomodulatory polypeptide of embodiment 87, wherein the IgSF domain exhibits increased binding to one or more of its cognate binding partner(s) compared to the binding of the unmodified or wild-type IgSF domain to the same one or more cognate binding partner(s).

89. The immunomodulatory polypeptide of any of embodiments 85-88, wherein the variant CTLA-4 is a first variant CTLA-4 polypeptide and the IgSF domain of the second polypeptide is an IgSF domain from a second variant CTLA-4 polypeptide of any of embodiments 1-75, wherein the first and second variant CTLA-4 are the same or different.

90. The immunomodulatory protein of any of embodiments 85-89, further comprising a third polypeptide comprising an IgSF domain of an IgSF family member or an affinity-modified IgSF domain thereof, said affinity-modified IgSF domain comprising one or more amino acid modifications compared to the unmodified or wild-type IgSF domain of the IgSF family member.

91. The immunomodulatory protein of embodiment 90, wherein:

the third polypeptide is the same as the first and/or second polypeptide; or the third polypeptide is different from the first and/or second polypeptide.

92. The immunomodulatory polypeptide of any of embodiments 85-91, wherein the IgSF domain or affinity-modified IgSF domain thereof, optionally of the second or third polypeptide, is or comprises an IgV domain.

93. The immunomodulatory polypeptide of any of embodiments 85-92, wherein the variant CTLA-4 polypeptide is or comprises an IgV domain.

94. The immunomodulatory protein of any of embodiments 85-93, wherein the immunomodulatory protein further comprises a multimerization domain linked to at least one of the variant CTLA-4 polypeptide, or the second polypeptide.

95. The immunomodulatory protein of any of embodiments 90-93, wherein the immunomodulatory protein further comprises a multimerization domain linked to at least one of the variant CTLA-4 polypeptide, the second polypeptide and/or the third polypeptide.

96. The immunomodulatory protein of embodiment 94 or embodiment 95, wherein the multimerization domain is an Fc domain or a variant thereof with reduced effector function.

97. The immunomodulatory protein of any of embodiments 94-96, wherein the multimerization domain promotes heterodimer formation.

98. An immunomodulatory protein comprising the immunomodulatory protein of any of embodiments 94-97, wherein the multimerization domain is a first multimerization domain and interacts with a second multimerization domain to form a multimer comprising the immunomodulatory protein.

99. The immunomodulatory protein of embodiment 98, wherein the immunomodulatory protein is a first immunomodulatory protein and a second immunomodulatory protein is linked directly or indirectly via a linker to the second multimerization domain, wherein the multimer comprises the first and second immunomodulatory protein.

100. The immunomodulatory protein of embodiment 99, wherein the second immunomodulatory protein is an immunomodulatory protein of any of embodiments 94-97, wherein the multimerization domain is the second multimerization domain.

101. An immunomodulatory protein comprising a first variant CTLA-4 polypeptide of any of embodiments 66-75 in which the multimerization domain is a first multimerization domain and a second variant CTLA-4 polypeptide of any of embodiments 66-75 in which the multimerization domain is a second multimerization domain, wherein the first and second multimerization domains interact to form a multimer comprising the first and second variant CTLA-4 polypeptides.

102. The immunomodulatory protein of any of embodiments 98-101, wherein the multimer is a dimer.

103. The immunomodulatory protein of any of embodiments 98-102 that is a homodimer.

104. The immunomodulatory protein of any of embodiments 98-103 that is a heterodimer.

105. The immunomodulatory protein of any of embodiments 98-104, wherein the first and/or second multimerization domain is an Fc domain or a variant thereof with reduced effector function.

106. The immunomodulatory protein of any of embodiments 98-105, wherein the first and second multimerization domains are the same or different.

107. A conjugate, comprising a variant CTLA-4 of any of embodiments 1-84 or an immunomodulatory protein of any of embodiments 6085-106, linked to a moiety.

108. The conjugate of embodiment 107, wherein the moiety is a targeting moiety that specifically binds to a molecule on the surface of a cell.

109. The conjugate of embodiment 108, wherein the targeting moiety specifically binds to a molecule on the surface of an immune cell.

110. The conjugate of embodiment 109, wherein the immune cell is an antigen presenting cell or a lymphocyte.

111. The conjugate of any of embodiments 108-110, wherein the targeting moiety localizes to a cell or tissue in an inflammatory environment.

112. The conjugate of any of embodiments 107-111, wherein the moiety is a protein, a peptide, nucleic acid, small molecule or nanoparticle.

113. The conjugate of any of embodiments 107-112, wherein the moiety is an antibody or antigen-binding fragment.

114. The conjugate of any of embodiments 107-113, wherein the conjugate is divalent, tetravalent, hexavalent or octavalent.

115. A nucleic acid molecule(s), encoding a variant CTLA-4 polypeptide of any of embodiments 1-84 or an immunomodulatory protein of any of embodiments 85-106.

116. The nucleic acid molecule of embodiment 115 that is a synthetic nucleic acid.

117. The nucleic acid molecule of embodiment 115 or embodiment 116 that is a cDNA.

118. A vector, comprising the nucleic acid molecule of any of embodiments 115-117.

119. The vector of embodiment 118 that is an expression vector.

120. The vector of embodiment 118 or embodiment 119, wherein the vector is a mammalian expression vector or a viral vector.

121. A cell, comprising the vector of any of embodiments 118-120.

122. The cell of embodiment 121 that is a mammalian cell.

123. The cell of embodiment 121 or embodiment 122 that is a human cell.

124. A method of producing a variant CTLA-4 polypeptide or an immunomodulatory protein, comprising introducing the nucleic acid molecule of any of embodiments 115-117 or vector of any of embodiments 118-120 into a host cell under conditions to express the protein in the cell.

125. The method of embodiment 124, further comprising isolating or purifying the variant CTLA-4 polypeptide or immunomodulatory protein from the cell.

126. A method of engineering a cell expressing a variant CTLA-4 polypeptide, comprising introducing a nucleic acid molecule encoding the variant CTLA-4 polypeptide of any of embodiments 1-84 or the immunomodulatory protein of any of embodiments 85-106 into a host cell under conditions in which the polypeptide is expressed in the cell.

127. An engineered cell, expressing the variant CTLA-4 polypeptide of any of embodiments 1-84, the immunomodulatory protein of any of embodiments 85-106, the nucleic acid molecule of any of embodiments 115-117 or the vector of any of embodiments 118-120.

128. The engineered cell of embodiment 127, wherein the cell is an immune cell.

129. The engineered cell of embodiment 128, wherein the immune cell is a lymphocyte.

130. The engineered cell of embodiment 129, wherein the lymphocyte is a T cell.

131. The engineered cell of embodiment 130, wherein the T cell is a CD4+ and/or CD8+ T cell.

132. The engineered cell of embodiment 130 or embodiment 131, wherein the T cell is a regulatory T cell (Treg).

133. The engineered cell of any of embodiments 127-132 that is a primary cell.

134. The engineered cell of any of embodiments 127-133, wherein the cell is a mammalian cell.

135. The engineered cell of any of embodiments 127-134, wherein the cell is a human cell.

136. The engineered cell of any of embodiments 127-135, wherein the CTLA-4 polypeptide is expressed on the surface of the cell via a transmembrane domain.

137. The engineered cell of embodiment 136, wherein the CTLA-4 polypeptide comprises a cytoplasmic domain, optionally wherein the cytoplasmic domain is linked, directly or indirectly, to the transmembrane domain.

138. The engineered cell of embodiment 137, wherein the cytoplasmic domain is or comprises a native CTLA-4 cytoplasmic domain, an intracellular signaling domain, and/or comprises an ITIM signaling motif.

139. The engineered cell of any of embodiments 136-138, wherein the cytoplasmic domain comprises the sequence of amino acids set forth as residues 183-223 of SEQ ID NO:1 or a functional variant thereof that exhibits at least 85% sequence identity to residues 183-223 of SEQ ID NO:1.

140. The engineered cell of embodiment 136 or embodiment 137, wherein the cytoplasmic domain comprises an ITAM signaling motif and/or is or comprises an intracellular signaling domain of CD3 zeta.

141. The engineered cell of embodiment 136, wherein the CTLA-4 polypeptide does not comprise a cytoplasmic signaling domain and/or is not capable of mediating or modulating an intracellular signal when expressed on a cell.

142. The engineered cell of any of embodiments 127-141, further comprising a chimeric antigen receptor (CAR).

143. The engineered cell of any of embodiments 127-141, further comprising an engineered T-cell receptor (TCR).

144. An infectious agent, comprising a nucleic acid molecule encoding a variant CTLA-4 polypeptide of any of embodiments 1-84 or an immunomodulatory protein of any of embodiments 85-106.

145. The infectious agent of embodiment 128, wherein the infectious agent is a bacterium or a virus.

146. A pharmaceutical composition, comprising the variant CTLA-4 polypeptide of any of embodiments 1-84, an immunomodulatory protein of any of embodiments 85-106, a conjugate of any of embodiments 107-114, an engineered cell of any of embodiments 127-143 or an infectious agent of embodiments 144 or embodiment 145.

147. The pharmaceutical composition of embodiment 146, comprising a pharmaceutically acceptable excipient.

148. The pharmaceutical composition of embodiment 146 or embodiment 147, wherein the pharmaceutical composition is sterile.

149. An article of manufacture comprising the pharmaceutical composition of any of embodiments 146-148 in a vial or container.

150. The article of manufacture of embodiment 149, wherein the vial or container is sealed.

151. A kit comprising the pharmaceutical composition of any of embodiments 146-148, and instructions for use.

152. A kit comprising the article of manufacture of embodiment 149 or embodiment 150, and instructions for use.

153. A method of modulating an immune response in a subject, comprising administering the pharmaceutical composition of any of embodiments 146-148 to the subject.

154. A method of modulating an immune response in a subject, comprising administering the engineered cells of any of embodiments 127-143.

155. The method of embodiment 154, wherein the engineered cells are autologous to the subject.

156. The method of embodiment 154, wherein the engineered cells are allogenic to the subject.

157. The method of any of embodiments 153-156, wherein modulating the immune response treats a disease or condition in the subject.

158. The method of any of embodiments 153-157, wherein the immune response is decreased.

159. The method of any of embodiments 153-158, wherein a variant polypeptide of any of embodiments 1-81, the immunomodulatory protein of any of embodiments 85-106 or the engineered cell of any of embodiments 127-139, 142 and 143 is administered to the subject.

160. The method of any of embodiments 153-159, wherein the disease or condition is an inflammatory or autoimmune disease or condition, or is a disease or condition associated with an overactive immune response.

161. The method of any of embodiments 153-160, wherein the disease or condition is an Antineutrophil cytoplasmic antibodies (ANCA)-associated vasculitis, a vasculitis, an autoimmune skin disease, transplantation, a Rheumatic disease, a thyroiditis, an inflammatory gastrointestinal disease, an inflammatory eye disease, an inflammatory neurological disease, an inflammatory pulmonary disease, an inflammatory endocrine disease, an autoimmune hematological disease, an autoimmune demyelinating disease, or an autoimmune disease involving a systemic autoimmune disorder.

162. The method of any of embodiments 153-161, wherein the disease or condition is selected from among inflammatory bowel disease, transplant, Crohn's disease, ulcerative colitis, asthma, autoimmune asthma, rheumatoid arthritis, psoriasis, lupus erythematosus, celiac disease, type I diabetes mellitus, Guillain-Barre syndrome, Chronic inflammatory demyelinating polyneuropathy, Graves' disease, Hashimoto's thyroiditis, DeQuervains thyroiditis, myasthenia gravis, Vasculitis, autoimmune hemolytic anemia, autoimmune atrophic gastritis of pernicious anemia, autoimmune encephalomyelitis, autoimmune orchitis, Goodpasture's disease, autoimmune thrombocytopenia, sympathetic opthalmia, primary biliary cirrhosis, chronic aggressive hepatitis, membranous glomerulopathy, primary idiopathic myxedema, scleroderma, chronic hepatitis, Addison's disease, hypogonadism, pernicious anemia, vitiligo, alopecia areata, autoimmune enteropathy syndrome, idiopathic thrombocytic purpura, acquired splenic atrophy, idiopathic diabetes insipidus, infertility due to antispermatazoan antibodies, sensoneural hearing loss, Sjogren's syndrome, polymyositis, multiple sclerosis, transverse myelitis, ataxic sclerosis, pemphigus, progressive systemic sclerosis, dermatomyositis, polyarteritis nodosa, hemolytic anemia, glomerular nephritis, and idiopathic facial paralysis.

163. The method of any of embodiments 153-157, wherein the immune response is increased.

164. The method of any of embodiments 137-141 and 147, wherein the engineered cell of embodiment 124 or embodiment 125 is administered to the subject.

165. The method of any of embodiments 137-141, 147 and 148, wherein the disease or condition is a tumor or cancer.

166. The method of any one of embodiments 137-141 and 147-149, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

IX. EXAMPLES

The following examples are included for illustrative purposes only and are not intended to limit the scope of the invention.

Example 1

Generation of Mutant DNA Constructs of IgSF Domains

Mutant DNA constructs of human CTLA-4 IgSF domains were generated for translation and expression on the surface of yeast as yeast display libraries.

Libraries containing random substitutions of amino acids were constructed to identify variants of the ECD of CTLA-4 based on a wild-type human CTLA-4 sequence set forth in SEQ ID NO: 2 as follows:

```
                                        (SEQ ID NO:2)
KAMHVAQPAVVLASSRGIASFVCEYASPGKATEVRVTVLRQADSQVTEV

CAATYMMGNELTFLDDSICTGTSSGNQVNLTIQGLRAMDTGLYICKVEL

MYPPPYYLGIGNGTQIYVIDPEPCPDSD
```

DNA encoding the wild-type CTLA-4 ECD was cloned between the BamHI and KpnI sites of the modified yeast display vector pBYDS03 (Life Technologies, USA). Mutations were introduced via error prone PCR utilizing the Genemorph II Kit (Agilent, USA) supplemented with $MnCl_2$ and using ECD-specific oligonucleotides which overlapped by 40 bp with pBYDS03 cloning vector beyond and including the BamHI and KpnI cloning sites. Mutagenized DNA PCR product was purified via agarose gel electrophoresis then further amplified using 100 ng of mutagenized PCR product with OneTaq 2×PCR Master Mix (New England Biolabs, USA). The products from the second PCR were purified via agarose gel electrophoresis and PCR-Gel purification (Qiagen, Germany) and resuspended in sterile deionized water. A total of 12 μg of PCR product was generated for each subsequent yeast electroporation.

To prepare for library insertion, pBYDS03 vector was digested with BamHI and KpnI restriction enzymes (New England Biolabs, USA) and the large vector fragment was gel-purified and dissolved in sterile, deionized water. Electroporation-ready DNA for the next step was generated by mixing 12 μg of library DNA insert with 4 μg of linearized vector in a total volume of 50 μL deionized and sterile water.

Example 2

Introduction of DNA Libraries into Yeast

The CTLA-4 DNA libraries, generated in Example 1, were introduced into yeast using electroporation. Briefly, electroporation-competent cells of yeast strain BJ5464 (ATCC.org; ATCC number 208288) were prepared and electroporated on a Gene Pulser II (Biorad, USA) with the electroporation-ready DNA from the steps above essentially as described (Colby, D. W. et al. 2004 Methods Enzymology 388, 348-358). The only exception is that transformed cells were grown in non-inducing minimal selective SCD-Leu medium to accommodate the LEU2 selectable marker carried by modified plasmid pBYDS03. One liter of SCD-Leu media consists of 14.7 grams sodium citrate, 4.29 grams citric acid monohydrate, 20 grams dextrose, 6.7 grams yeast nitrogen base, and 1.6 grams yeast synthetic drop-out media supplement without leucine. The Medium was filter sterilized before use using a 0.22 μm vacuum filter device.

Library size was determined by plating serial dilutions of freshly recovered cells on SCD-Leu agar plates and then extrapolating library size from the number of single colonies from plating that generated at least 50 colonies per plate. In general, library sizes ranged from 10E8 to 10E9 transformants based on this dilution assay. The remainder of the electroporated culture was grown to saturation in SCD-Leu and cells from this culture were subcultured (e.g., 1/100) into fresh SCD-Leu once more to minimize the fraction of untransformed cells, and grown overnight. To maintain library diversity, this subculturing step was carried out using an inoculum that contained at least 10 times more cells than the calculated library size. Cells from the second saturated culture were resuspended in fresh medium containing sterile 25% (weight/volume) glycerol to a density of 10E10/mL and frozen and stored at −80° C. (frozen library stock).

Example 3

Yeast Selection

Yeast, expressing affinity modified variants of CTLA-4 were selected against ICOSL and/or CD86.

A number of cells equal to at least 10 times the estimated library size were thawed from individual library stocks, suspended to 1.0×10E6 cells/mL in non-inducing SCD-Leu medium, and grown overnight. The next day, a number of cells equal to 10 times the library size were centrifuged at 2000 RPM for two minutes and resuspended to 5.0×10E6 cells/mL in inducing SCDG-Leu medium. One liter of the SCDG-Leu induction media consisted of 5.4 grams $Na_2HPO_4$, 8.56 grams of $NaH_2PO_4 \cdot H_2O$, 20 grams galactose, 2.0 grams dextrose, 6.7 grams yeast nitrogen base, and 1.6 grams of yeast synthetic drop out media supplement without leucine dissolved in water and sterilized through a 0.22 μm membrane filter device. The culture was grown in induction medium for 1 day at room temperature to induce expression of library proteins on the yeast cell surface.

The induced yeast library underwent 4 cycles of bead sorts using magnetic beads loaded alternately with ICOSL or CD86 to reduce non-binders and enrich for variant CTLA-4 molecules with the ability to bind ICOSL or CD86. After each cycle of selection, yeast retained through binding to magnetic beads were amplified through growth in SCD media followed by overnight induction in SCDG media. The preliminary selection was followed by two rounds of fluorescence activated cell sorting (FACS) using ICOSL-Fc in round 1 and CD86-Fc in round 2 to enrich the fraction of yeast cells that displays improved binders. Magnetic bead enrichment and selections by flow cytometry were carried out essentially as described in Miller et al., Current Protocols in Cytometry 4.7.1-4.7.30, July 2008.

This selection process utilized the following reagents and instruments: human rICOSL.Fc (i.e., recombinant ICOSL-Fc fusion protein) and human rCD86.Fc target ligand proteins were purchased from R & D Systems, USA. Magnetic Protein A beads were obtained from New England Biolabs, USA. For two-color, flow cytometric sorting, a Bio-Rad S3e sorter was used. CTLA-4 display levels were monitored with an anti-hemagglutinin antibody labeled with Alexafluor 488 (Life Technologies, USA). Ligand binding of Fc fusion proteins, rICOSL.Fc or rCD86.Fc, were detected with PE-conjugated human Ig specific goat Fab (Jackson ImmunoResearch, USA). Doublet yeast were gated out using forward scatter (FSC)/side scatter (SSC) parameters, and sort gates were based upon higher ligand binding detected in FL2 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population was then compared to the parental, wild-type yeast strain, or other selected outputs, such as the bead output yeast population, by flow cytometry.

After the second round of FACS the output was serially diluted and plated onto SCD-agar such that single clones could be isolated. Two hundred and eighty eight colonies were picked into round bottom microtiter plates containing 150 μL SCD media supplemented with kanamycin, penicillin and streptomycin. Plates were incubated at 30° C. with shaking. After 4h of growth, 80 μL were transferred to wells of a new plate, cells were spun down, SCD removed, 200 μL of SCDG induction media supplemented with antibiotics were added to each well followed by overnight incubation at room temperature with shaking. FACS analysis was used to independently assess binding of each clone to rICOSL-Fc, rCD86-Fc and anti-HA Mab as a control for expression. Control wells of yeast bearing wildtype CTLA-4 were run on each plate. 16 clones were selected to be reformatted into Fc fusion constructs and sequenced as described below.

Sequence analysis of the 16 yeast clones revealed a single dominant combination of mutations (L12P/A26T/L63P/L98Q/Y105L; SEQ ID NO: 4). In order to generate additional clonal diversity and determine the minimal mutations required for enhanced binding, the mutations in this clone were partially shuffled with wildtype sequence. Briefly, three pairs of PCR primers were designed that divided the ECD coding region into thirds. The PCR primers maintained 20 bp overlapping sequence with adjacent PCR product in order to facilitate subsequent Gibson Assembly cloning. Three PCR products were generated from both wildtype $A_1$, $B_1$, $C_1$) and mutant template ($A_2$, $B_2$, $C_2$). Combinations of 3 PCR products, e.g. $A_2$, $B_1$, $C_1$; $A_2$, $B_2$, $C_1$ etc., were mixed with a modified Fc fusion vector to carry out in vitro recombination using Gibson Assembly Mastermix (New England Biolabs, USA), which was subsequently used for heat shock transformation into *E. coli* strain NEB® 5-alpha. This shuffling with wildtype sequence yielded SEQ ID NOS: 5-11.

A second library of random mutations was generated via error prone PCR using the clones from Gen1 selection as template. This library, described as a Gen2, was constructed using the same process previously described except that template DNA was composed of a pool of Gen1 clones instead of wildtype CTLA-4 ECD DNA. The yeast library was screened via iterative rounds of FACS sorting, alternating between rICOSL-Fc and rCD86-Fc, to generate multiple pools of clones. As before, yeast pools were analyzed for binding via FACS. Based on the binding to rICOSL-Fc, rCD86-Fc, rCD80-Fc by FACS, several pools were selected for PCR cloning into the Fc vector. Subsequent sequence analysis and protein production were performed as described for Gen1.

Amino acid substitutions in selected variants that were identified by the selection are set forth in Table 2. Selected variant CTLA-4 ECDs were further formatted as fusion proteins and tested for binding and functional activity as described below.

Example 4

Reformatting Selection Outputs as Fc-Fusions and in Various Immunomodulatory Protein Types Selection outputs were reformatted as immunomodulatory proteins containing an affinity-modified (variant) ECD of CTLA-4 fused to an Fc molecule (variant ECD-Fc fusion molecules).

Output cells from final flow cytometric CTLA-4 sorts were grown to terminal density in SCD-Leu medium. Plasmid DNA from each output was isolated using a yeast plasmid DNA isolation kit (Zymoresearch, USA). For Fc fusions, PCR primers with added restriction sites suitable for cloning into the Fc fusion vector of choice were used to batch-amplify from the plasmid DNA preps the coding DNA for the mutant target ECDs. After restriction digestion, the PCR products were ligated into an appropriate Fc fusion vector followed by heat shock transformation into strain XL1-Blue *E. coli* (Agilent, USA) or NEB® 5-alpha (New England Biolabs) as directed by supplier. Alternatively, the outputs were PCR amplified with primers containing 40 bp overlap regions on either end with a modified Fc fusion vector to carry out in vitro recombination using Gibson Assembly Mastermix (New England Biolabs, USA), which was subsequently used for heat shock transformation into *E. coli* strain NEB® 5-alpha. An exemplary Fc fusion vector is pFUSE-hIgG1-Fc2 (InvivoGen, USA).

Dilutions of transformation reactions were plated on LB-agar containing 100m/mL carbenicillin (Teknova, USA) to isolate single colonies for selection. Up to 96 colonies from each transformation were then grown in 96-well plates to saturation overnight at 37° C. in LB-broth (cat. #L8112, Teknova, USA), and a small aliquot from each well was submitted for DNA sequencing of the ECD insert in order to identify the mutation(s) in all clones. Sample preparation for DNA sequencing was carried out using protocols provided by the service provider (Genewiz; South Plainfield, N.J.). After removal of the sample for DNA sequencing, glycerol was added to the remaining cultures for a final glycerol content of 25%, and plates were stored at −20° C. for future use as master plates (see below). Alternatively, samples for DNA sequencing were generated by replica plating from grown liquid cultures to solid agar plates using a disposable 96-well replicator (VWR, USA). These plates were incubated overnight to generate growth patches and the plates were submitted to Genewiz for DNA sequencing following their specifications.

After analysis of Genewiz-generated DNA sequencing data, clones of interest were recovered from master plates and individually grown to saturation in 5 mL liquid LB-broth containing 100 μg/mL carbenicillin (Teknova, USA) and 2 mL of each culture were then used for preparation of approximately 10 μg of miniprep plasmid DNA of each clone using a standard kit such as the PureYield Plasmid Miniprep System (Promega, USA). Identification of clones of interest generally involved the following steps. First, DNA sequence data files were downloaded from the Genewiz website. All sequences were then manually curated so that they start at the beginning of the ECD coding region. The Genewiz sequences were processed to generate alignments using Ugene software (http://ugene.net).

Clones of interest were then identified using the following criteria: 1) identical clone occurs at least two times in the alignment, and 2) a mutation occurs at least two times in the alignment and preferably in distinct clones. Clones that met at least one of these criteria were enriched by the sorting process mostly likely due to improved binding.

To generate recombinant immunomodulatory proteins that are Fc fusion proteins containing an ECD of CTLA-4 with at least one affinity-modified domain (e.g., variant CTLA-4 ECD-Fc), the encoding DNA was generated to encode a protein as follows: variant (mutant) ECD followed by a linker of 7 amino acids (GSGGGGS) followed by a human IgG1 Fc containing the mutations L234A, L235E and G237A by EU numbering. Since the construct does not include any antibody light chains that can form a covalent bond with a cysteine, the human IgG1 Fc also contained replacement of the cysteine residues to a serine residue at position 220 (C220S) by EU numbering (corresponding to position 5 (C5S) with reference to the wild-type or unmodified Fc set forth in SEQ ID NO: 533). Exemplary variant CTLA-4-ECD-Fc fusion proteins, containing the variants set forth in Table 2 are set forth in SEQ ID NOS: 286-379, 381-386, and 388-437.

Example 5

Expression and Purification of Fc-Fusions

The Fc-fusion proteins, containing variant ECDs of CTLA-4, were generated by high throughput expression and purification. Recombinant variant Fc fusion proteins were produced from suspension-adapted human embryonic kidney (HEK) 293 cells using the Expi293 expression system (Invitrogen, USA). 4 μg of each plasmid DNA, generated in Example 3, were added to 200 μL Opti-MEM (Invitrogen, USA) at the same time as 10.8 μL ExpiFectamine were separately added to another 200 μL Opti-MEM. After 5 minutes, the 200 μL of plasmid DNA was mixed with the 200 μL of ExpiFectamine and was further incubated for an additional 20 minutes before adding this mixture to cells. Ten million Expi293 cells were dispensed into separate wells of a sterile 10 mL, conical bottom, deep 24-well growth plate (Thomson Instrument Company, USA) in a volume of 4 mL Expi293 media (Invitrogen, USA). Plates were shaken for 5 days at 120 RPM in a mammalian cell culture incubator set to 95% humidity and 8% $CO_2$. Following a 5-day incubation, cells were pelleted and culture supernatants were removed.

Protein was purified from supernatants using a high throughput 96-well Protein A purification kit using the manufacturer's protocol (Catalog number 45202, Life Technologies, USA). Resulting elution fractions were buffer-exchanged into PBS using Zeba 96-well spin desalting plate (Catalog number 89807, Life Technologies, USA) using the manufacturer's protocol. Purified protein was quantitated using 280 nm absorbance measured by Nanodrop instrument (Thermo Fisher Scientific, USA), and protein purity was assessed by loading 5 μg of protein on NUPAGE pre-cast, polyacrylamide gels (Life Technologies, USA) under denaturing and reducing conditions and subsequent gel electrophoresis. Proteins were visualized in gel using standard Coomassie staining.

Example 6

Assessment of Binding and Activity of Affinity-Matured IgSF Domain-Containing Molecules Fc-fusion binding studies were performed to assess specificity and affinity of CTLA-4 ECD variant immunomodulatory proteins for binding partners CD80, CD86, and ICOSL. The Fc-fusion variant proteins were further characterized for bioactivity in human primary T cells in vitro assays.

A. Binding to Cell-Expressed Counter Structures

To produce cells expressing a binding partner, full-length mammalian surface expression constructs for each of human CD80, CD86, and ICOSL were designed in pcDNA3.1 expression vectors (Life Technologies) and sourced from Genscript, USA. Binding studies were carried out using the Expi293F transient transfection system (Life Technologies, USA) described above. The number of cells needed for the experiment was determined, and the appropriate 30 mL scale of transfection was performed using the manufacturer's suggested protocol. For each counter structure or mock 30 mL transfection, 75 million Expi293F cells were incubated with 30 μg expression construct DNA and 1.5 mL diluted ExpiFectamine 293 reagent for 48 hours, at which point cells were harvested for staining.

For flow cytometric analysis, 200,000 cells of appropriate transient transfection or negative control were plated in 96 well round bottom plates. Cells were spun down and suspended in staining buffer (PBS (phosphate buffered saline), 1% BSA (bovine serum albumin), and 0.1% sodium azide) for 20 minutes to block non-specific binding. Afterwards, cells were centrifuged again and suspended in staining buffer containing 100 nM to 100 pM CTLA-4 IgSF variant Fc fusion protein in 50 μL. Primary staining was performed for 45 minutes, before washing cells in staining buffer twice. For CD86 transfections, bound protein was detected with PE-conjugated anti-human Fc (Jackson ImmunoResearch, USA) diluted 1:150 in 50 μL staining buffer incubated for 30 minutes. For CD80 and ICOSL transfections, bound protein was captured with anti-CTLA-4 antibody (Biolegend, USA) diluted 1:130 in 50 μL staining buffer. After a 30 minute incubation, cells were washed twice and detected with PE-conjugated anti-mouse Fc (Jackson ImmunoResearch, USA) diluted 1:150 in 50 μL for an additional 30 minute incubation. Cells were washed twice to remove unbound conjugated antibodies, fixed in 2% formaldehyde/PBS, and analyzed on a FACScan (Becton Dickinson, USA) or a Hypercyt flow cytometer (Intellicyte, USA).

Mean Fluorescence Intensity (MFI) was calculated for each transfectant and negative parental line with Cell Quest Pro software (Becton Dickinson, USA) or Forcyte software (Intellicyt, USA).

B. Bioactivity Characterization

Soluble CTLA-4-Fc bioactivity was tested in a human Mixed Lymphocyte Reaction (MLR). Human primary dendritic cells (DC) generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). On days 3 and 5, half of the media was removed and replaced with fresh media containing 50 ng/mL rIL-4 and 80 ng/mL rGM-CSF. To fully induce DC maturation, lipopolysaccharide (LPS) (InvivoGen Corp., USA) was added at 100 ng/mL to the DC cultures on day 6 and cells were incubated for an additional 24 hours. Approximately, 10,000 matured DC and 100,000 purified allogeneic CD3+ T cells (BenTech Bio, USA) were co-cultured with CTLA-4 variant Fc fusion proteins and controls in 96 well round bottom plates in 200 μl final volume of Ex-Vivo 15 media. On day 4-5, IFN-gamma secretion in culture supernatants was analyzed using the Human IFN-gamma Duoset ELISA kit (R&D Systems, USA). Optical density was measured on a BioTek Cytation Multimode Microplate Reader (BioTek Corp., USA) and quantitated against titrated rIFN-gamma standard included in the IFN-gamma Duo-set kit (R&D Systems, USA).

C. Results

The results of the binding and bioactivity assays described above for the variant and unmodified CTLA-4 polypeptides are summarized in Tables 5-7. The values for binding CD80, CD86, and ICOSL (MFI) and interferon-gamma secretion [pg/mL] are provided in addition to the relative ratio, as compared to the corresponding binding and secretion of the unmodified CTLA-4 polypeptide (ΔWT) for each experiment. Relative ratios for binding that were substantially below 0.1, are reported as 0. In addition, MLR data for variants in which the variant suppressed the secretion of interferon gamma to undetectable levels also is reported as 0.

TABLE 5

Binding and bioactivity of variant CTLA-4-Fc polypeptides

| Mutations | SEQ ID NO (ECD) | Binding CD80 MFI (Δ WT) | CD86 MFI (Δ WT) | ICOSL MFI (Δ WT) | MLR IFN-γ [pg/mL] (Δ WT) |
|---|---|---|---|---|---|
| L12P/A26T/L63P/L98Q/Y105L | 4 | 829 (0.2) | 761890 (1.1) | 873 (0.5) | 216 (0.3) |
| L12P/A26T | 6 | 1024 (0.2) | 276276 (0.4) | 928 (0.6) | 850 (1.3) |
| L12P/A26T/L63P | 7 | 2400 (0.5) | 500345 (0.7) | 891 (0.5) | 671 (1.0) |
| L63P/L98Q/Y105L | 8 | 4718 (1.0) | 410571 (0.6) | 1802 (1.1) | 124 (0.2) |
| L98Q/Y105L | 9 | 3863 (0.8) | 685365 (1.0) | 1186 (0.7) | 124 (0.2) |
| L63P | 10 | 3932 (0.8) | 595807 (0.8) | 966 (0.6) | 261 (0.4) |
| L98R/N110K | 11 | 2110 (0.4) | 665012 (0.9) | 1046 (0.6) | 344 (0.5) |
| WT CTLA-4 | 2 | 4775 (1.0) | 708753 (1.0) | 1664 (1.0) | 662 (1.0) |

TABLE 6

Binding and bioactivity of variant CTLA-4-Fc polypeptides

| Mutations | SEQ ID NO (ECD) | Binding CD80 MFI (Δ WT) | CD86 MFI (Δ WT) | ICOSL MFI (Δ WT) | MLR IFN-α [pg/mL] (Δ WT) |
|---|---|---|---|---|---|
| L12P/A26T/L63P/L98Q/M99L/Y105L | 12 | 2026 (0.4) | 33068 (0.9) | 1222 (0.7) | 569 (1.5) |
| E33M/Q82H/L98Q/M99L/Y105L | 13 | 1098 (0.2) | 35506 (1.0) | 1792 (1.1) | 253 (0.7) |
| L63P/S72G/L98Q/M99L/Y105L | 14 | 2591 (0.5) | 33477 (0.9) | 1604 (1.0) | 586 (1.6) |
| S14N/R16C/I18T/M56K/T61A/L63P/A86T/M99L | 15 | 3773 (0.8) | 30572 (0.8) | 990 (0.6) | 441 (1.2) |
| S27P/M56K/L63P/S72G/S73R/T89A/M99L/Y105L/I117M | 16 | 1982 (0.4) | 33467 (0.9) | 1354 (0.8) | 426 (1.1) |
| M56K/L63P/N75D/V96I/M99L/Y105L/L106I | 17 | 3775 (0.8) | 31296 (0.9) | 1719 (1.0) | 583 (1.6) |
| L63P/S72G/Y105L | 18 | 3831 (0.8) | 32160 (0.9) | 1362 (0.8) | 123 (0.3) |
| L63P/L98Q/M99L/Y105L/I117M | 19 | 2635 (0.6) | 32564 (0.9) | 1761 (1.1) | 539 (1.4) |
| L63P/S72G/L98Q/M99L/Y105L/L106I/I117L | 20 | 2463 (0.5) | 32830 (0.9) | 1930 (1.2) | 603 (1.6) |
| A26T/L63P/S72G/L98Q/Y105L/L106I/I117L | 21 | 3576 (0.7) | 31549 (0.9) | 939 (0.6) | 83 (0.2) |
| L63P/L98Q/V116A | 22 | 2772 (0.6) | 32657 (0.9) | 1033 (0.6) | 298 (0.8) |
| G29W/L98Q/M99L/Y105L | 23 | 1772 (0.4) | 32977 (0.9) | 6183 (3.7) | 745 (2.0) |
| T37S/M56V/L98Q/Y105L | 24 | 2115 (0.4) | 27628 (0.8) | 881 (0.5) | 148 (0.4) |
| A26T/Y54F/M56K/M99L/Y105L | 25 | 1526 (0.3) | 28149 (0.8) | 1113 (0.7) | 552 (1.5) |
| L12P/I18T/A26T/M55T/T69S/S72G/M99L/Y105L | 26 | 1577 (0.3) | 25936 (0.7) | 931 (0.6) | 944 (2.5) |
| V22I/L63P/L98Q/Y105L/I117M | 27 | 2802 (0.6) | 27629 (0.8) | 1013 (0.6) | 103 (0.3) |
| A26T/L63P/S72G/L98Q/M99L/Y105L | 28 | 2899 (0.6) | 26407 (0.7) | 1759 (1.1) | 195 (0.5) |
| I18T/T61R/L63P/S72G/L98Q/M99L/P102L/Y105L | 636 | 1140 (0.2) | 46974 (1.3) | 935 (0.6) | 714 (1.9) |
| E33M/A42T/L98Q/Y105L | 29 | 1623 (0.3) | 27354 (0.7) | 1675 (1.0) | 638 (1.7) |
| M55T/E97Q/M99L/Y105F | 30 | 906 (0.2) | 6249 (0.2) | 1037 (0.6) | 575 (1.5) |

TABLE 6-continued

| Binding and bioactivity of variant CTLA-4-Fc polypeptides | | | | | |
|---|---|---|---|---|---|
| | SEQ | Binding | | | MLR |
| Mutations | ID NO (ECD) | CD80 MFI (Δ WT) | CD86 MFI (Δ WT) | ICOSL MFI (Δ WT) | IFN-α [pg/mL] (Δ WT) |
| M55T/S72G/L98Q/M99L/Y105L | 31 | 1940 (0.4) | 30594 (0.8) | 2313 (1.4) | 594 (1.6) |
| R16C/G29W/E33V/M55T/L63P/L98Q/Y105L | 32 | 2678 (0.6) | 28858 (0.8) | 1480 (0.9) | 144 (0.4) |
| L12P/A26T/L63P/L98Q/Y105L/L106I | 33 | 2318 (0.5) | 28463 (0.8) | 879 (0.5) | 127 (0.3) |
| M56L/L63P/L98Q/Y105L/L106I/I117L | 34 | 3487 (0.7) | 32054 (0.9) | 963 (0.6) | 72 (0.2) |
| S15P/I18V/M56T/L98Q/M99L/Y105L | 35 | 1445 (0.3) | 33793 (0.9) | 1505 (0.9) | 622 (1.7) |
| I18T/G29W/L63P/L98Q/Y105L | 36 | 10109 (2.1) | 29367 (0.8) | 1711 (1.0) | 50 (0.1) |
| L63P/Q82H/L98Q/M99L/Y105L | 37 | 2777 (0.6) | 31740 (0.9) | 2110 (1.3) | 723 (1.9) |
| L98Q/M99L/Y105L/L106I/I117T | 38 | 1117 (0.2) | 28174 (0.8) | 1081 (0.6) | 944 (2.5) |
| L98Q/M99L/Y105L/L106I/Y115N | 39 | 1074 (0.2) | 27514 (0.7) | 939 (0.6) | 322 (0.9) |
| M55T/L63P/T71I/M99L/Y105L | 40 | 2900 (0.6) | 24010 (0.7) | 1125 (0.7) | 384 (1.0) |
| A26T/T53S/M56K/L63P/L98Q/Y105L | 41 | 3352 (0.7) | 23688 (0.6) | 1042 (0.6) | 88 (0.2) |
| I18T/A26T/L63P/Q82R/L98Q/Y105L | 42 | 3650 (0.8) | 26133 (0.7) | 923 (0.6) | 105 (0.3) |
| L12H/M55T/E59D/L63P/M99L | 43 | 2877 (0.6) | 26206 (0.7) | 876 (0.5) | 619 (1.7) |
| I18T/L63P/S72G/L98Q/Y105L/I108V | 44 | 2706 (0.6) | 26196 (0.7) | 960 (0.6) | 62 (0.2) |
| I18T/L63P/S72G/L98Q/M99L/Y105L | 45 | 2442 (0.5) | 29111 (0.8) | 2489 (1.5) | 817 (2.2) |
| T61A/L63P/S72G/L98Q/M99L/Y105L | 46 | 2505 (0.5) | 32390 (0.9) | 1987 (1.2) | 944 (2.5) |
| V38I/L63P/S72G/L98Q/M99L/Y105L | 47 | 3433 (0.7) | 33373 (0.9) | 2410 (1.4) | 846 (2.3) |
| L63P/S72G/I93L/L98Q/M99L/Y105L | 48 | 3282 (0.7) | 32885 (0.9) | 2277 (1.4) | 897 (2.4) |
| L12I/M55T/M56V/I67T/M99L/L106R/I108F | 49 | 2917 (0.6) | 31744 (0.9) | 2485 (1.5) | 842 (2.3) |
| I18N/A26T/L63H/T89A/L98Q/M99L/Y105L | 50 | 1943 (0.4) | 31558 (0.9) | 2175 (1.3) | 689 (1.8) |
| I18T/E48R/L63P/T69S/L98Q/Y105L/N110Y | 51 | 1086 (0.2) | 23508 (0.6) | 1124 (0.7) | 645 (1.7) |
| I18N/L63P/S72T/M87T/L98Q/Y105L/N110S | 52 | 1998 (0.4) | 36385 (1.0) | 1032 (0.6) | 73 (0.2) |
| G29W/M56T/L63P/L98Q/Y105L/L106I/I117L | 53 | 3308 (0.7) | 32787 (0.9) | 1258 (0.8) | 78 (0.2) |
| G29W/N58S/L63P/M87T/L98Q/M99L/Y105L | 54 | 3381 (0.7) | 32622 (0.9) | 3622 (2.2) | 578 (1.6) |
| G29W/N58S/L63P/D64N/L98Q/M99L/Y105L | 55 | 3750 (0.8) | 33612 (0.9) | 2158 (1.3) | 227 (0.6) |
| I18T/L63P/S72G/M87K/L98Q/M99L/Y105L | 56 | 2925 (0.6) | 35032 (1.0) | 1999 (1.2) | 679 (1.8) |
| WT CTLA4 | 2 | 4775 (1.0) | 36785 (1.0) | 1664 (1.0) | 373 (1.0) |

TABLE 7

| Binding and bioactivity of variant CTLA-4-Fc polypeptides | | | | | |
|---|---|---|---|---|---|
| | | Binding | | | MLR |
| Mutations | SEQ ID NO (ECD) | CD80 MFI (Δ WT) | CD86 MFI (Δ WT) | ICOSL MFI (Δ WT) | IFN-γ [pg/mL] (Δ WT) |
| M56V | 57 | 2688 (0.6) | 36766 (0.1) | 822 (0.5) | 176 (1.3) |
| L63P/K95R | 58 | 2914 (0.6) | 33412 (0.0) | 819 (0.5) | 165 (1.2) |

TABLE 7-continued

| Binding and bioactivity of variant CTLA-4-Fc polypeptides | | | | | |
|---|---|---|---|---|---|
| | | Binding | | | MLR |
| Mutations | SEQ ID NO (ECD) | CD80 MFI (Δ WT) | CD86 MFI (Δ WT) | ICOSL MFI (Δ WT) | IFN-γ [pg/mL] (Δ WT) |
| L63P/L98Q | 59 | 2830 (0.6) | 31416 (0.0) | 885 (0.5) | 229 (1.6) |
| L98Q/M99L/Y105L | 60 | 1472 (0.3) | 33977 (0.0) | 1541 (0.9) | 325 (2.3) |
| L63P/M87K/M99L/L106R | 61 | 3329 (0.7) | 61526 (0.1) | 2540 (1.5) | 531 (3.8) |
| L63P/M99L/Y105L/I108F | 62 | 2142 (0.4) | 32781 (0.0) | 3759 (2.3) | 1053 (7.5) |
| V10A/L63P/L98Q/Y105L | 63 | 3148 (0.7) | 34595 (0.0) | 869 (0.5) | 141 (1.0) |
| M56T/L91R/L98Q/Y105L | 64 | 1713 (0.4) | 33645 (0.0) | 1128 (0.7) | 0 (0.0) |
| A26T/L63P/M87V/N110K/I117E | 65 | 2909 (0.6) | 31487 (0.0) | 973 (0.6) | 426 (3.0) |
| G29W/L63P/L98Q/M99L/Y105L | 66 | 5165 (1.1) | 37721 (0.1) | 3023 (1.8) | 438 (3.1) |
| A26T/V46E/L63P/D65G/L98Q | 67 | 5009 (1.0) | 38407 (0.1) | 888 (0.5) | 273 (1.9) |
| G29W/N58S/L63P/L98Q/Y105L | 68 | 15619 (3.3) | 34897 (0.0) | 1374 (0.8) | 0 (0.0) |
| G29W/E59G/L63P/L98Q/Y105L | 69 | 3214 (0.7) | 32786 (0.0) | 1148 (0.7) | 0 (0.0) |
| L12H/L63P/S72G/L98Q/Y105L | 70 | 2034 (0.4) | 31843 (0.0) | 857 (0.5) | 87 (0.6) |
| A6T/A26T/M55T/M99L/Y105L | 71 | 1429 (0.3) | 33589 (0.0) | 938 (0.6) | 472 (3.4) |
| A26T/L63P/D65G/L98Q/M99L/Y105L | 72 | 2324 (0.5) | 33672 (0.0) | 2200 (1.3) | 264 (1.9) |
| V10A/L63P/D64V/S72G/L98Q/M99L/Y105L | 73 | 2598 (0.5) | 33868 (0.0) | 2502 (1.5) | 904 (6.4) |
| L12P/G29W/D43N/N58S/L63P/L98Q/M99L/Y105L | 74 | 1486 (0.3) | 30004 (0.0) | 1276 (0.8) | 352 (2.5) |
| I18V/A26T/L63P/D64E/L98Q/Y105L/L106R/N110K | 75 | 4096 (0.9) | 30852 (0.0) | 17220 (10.3) | 0 (0.0) |
| A19V/G29W/R35K/L63P/L98Q/M99L/Y105L | 76 | 2349 (0.5) | 33255 (0.0) | 3119 (1.9) | 445 (3.2) |
| L12P/A26T/L63P/S72G/T89M/L98Q/M99L/Y105L | 77 | 1833 (0.4) | 924222 (1.3) | 919 (0.6) | 536 (3.8) |
| P28L/E33V/L63P/S72G/L98R/M99L/Y105L | 78 | 1441 (0.3) | 782025 (1.1) | 966 (0.6) | 535 (3.8) |
| E24Q/L63P/S72G/L98Q/M99L/Y105L | 79 | 2864 (0.6) | 729343 (1.0) | 1080 (0.6) | 867 (6.2) |
| I18T/G29R/L63P/S72G/L98Q/M99L/Y105L | 80 | 3592 (0.8) | 857127 (1.2) | 1014 (0.6) | 366 (2.6) |
| L63P/L98Q/M99L/Y105L | 81 | 2662 (0.6) | 618249 (0.9) | 868 (0.5) | 944 (6.7) |
| Q41L/Y54F/M56K/M99L/I108F | 82 | 2570 (0.5) | 703731 (1.0) | 940 (0.6) | 408 (2.9) |
| S72G/L98Q/M99L/Y105L/I117T | 83 | 1374 (0.3) | 863538 (1.2) | 968 (0.6) | 221 (1.6) |
| M56R/L63P/L98Q/M99L/Y105L | 84 | 2546 (0.5) | 911035 (1.3) | 839 (0.5) | 1198 (8.5) |
| E33M/L63P/S72G/L98Q/Y105L | 85 | 1532 (0.3) | 518203 (0.7) | 999 (0.6) | 1220 (8.7) |
| L63P/L98Q/M99L/Y105L/L106I | 86 | 2814 (0.6) | 1007606 (1.4) | 1004 (0.6) | 773 (5.5) |
| A26T/M55R/L98Q/M99L/Y105L | 87 | 2324 (0.5) | 520232 (0.7) | 986 (0.6) | 468 (3.3) |
| L63P/S72G/M87A/L98Q/Y105L | 88 | 2769 (0.6) | 349875 (0.5) | 875 (0.5) | 202 (1.4) |
| A26D/S72G/L98Q/M99L/Y105L | 89 | 5409 (1.1) | 578704 (0.8) | 1235 (0.7) | 1097 (7.8) |
| V22A/L63P/L98Q/M99L/Y105L/P119H | 90 | 2820 (0.6) | 642849 (0.9) | 992 (0.6) | 1174 (8.4) |
| A26T/M55T/L63P/L98Q/M99L/Y105L | 91 | 3203 (0.7) | 850654 (1.2) | 875 (0.5) | 1096 (7.8) |
| E33V/A42S/M55T/L98Q/M99L/Y105L | 92 | 2195 (0.5) | 929792 (1.3) | 1043 (0.6) | 1478 (10.5) |
| G29W/N58S/L63P/Q82R/L98Q/Y105L | 93 | 18277 (3.8) | 950639 (1.3) | 1463 (0.9) | 0 (0.0) |
| E33M/L63P/S72G/L98Q/Y105L/I117L | 94 | 2293 (0.5) | 912480 (1.3) | 907 (0.5) | 586 (4.2) |

TABLE 7-continued

| Binding and bioactivity of variant CTLA-4-Fc polypeptides | | | | | |
|---|---|---|---|---|---|
| | | Binding | | | MLR |
| Mutations | SEQ ID NO (ECD) | CD80 MFI (Δ WT) | CD86 MFI (Δ WT) | ICOSL MFI (Δ WT) | IFN-γ [pg/mL] (Δ WT) |
| A26T/I67N/S72G/L98Q/M99L/Y105L | 95 | 1740 (0.4) | 976150 (1.4) | 948 (0.6) | 1331 (9.5) |
| L12F/A26T/L63P/L98Q/Y105L/L106R | 96 | 2186 (0.5) | 984573 (1.4) | 867 (0.5) | 1286 (9.2) |
| S20N/A26T/L63P/L98Q/M99L/Y105L | 97 | 3707 (0.8) | 941466 (1.3) | 1020 (0.6) | 1879 (13.4) |
| G29W/T61I/L63P/S72G/L98Q/M99L/Y105L | 99 | 3446 (0.7) | 842791 (1.2) | 1024 (0.6) | 718 (5.1) |
| G29W/N58S/L63P/T69I/L98Q/M99L/Y105L | 100 | 4558 (1.0) | 841939 (1.2) | 1945 (1.2) | 1036 (7.4) |
| L12P/L63P/S72G/L98Q/M99L/Y105L/L106N | 101 | 2991 (0.6) | 854863 (1.2) | 894 (0.5) | 0 (0.0) |
| L63P/T69A/L98Q/M99L/Y105L/L106R/V116A | 102 | 3984 (0.8) | 831276 (1.2) | 1765 (1.1) | 0 (0.0) |
| G29W/N58S/L63P/S72G/L98Q/Y105L | 103 | 4262 (0.9) | 860194 (1.2) | 1445 (0.9) | 0 (0.0) |
| G29W/L63P/D65G/S72G/L98Q/Y105L | 104 | 3399 (0.7) | 854339 (1.2) | 954 (0.6) | 0 (0.0) |
| T53S/M56V/L98Q/Y105L | 106 | 3860 (0.8) | 875378 (1.2) | 1376 (0.8) | 0 (0.0) |
| L63P/S72G/L98Q/Y105L | 107 | 3451 (0.7) | 892268 (1.3) | 1486 (0.9) | 0 (0.0) |
| I18A/L63P/S72G/L98Q/Y105L | 108 | 3542 (0.7) | 637802 (0.9) | 1240 (0.7) | 0 (0.0) |
| G29W/T53S/M56K/L63P/L98Q/Y105L | 109 | 3347 (0.7) | 794165 (1.1) | 1914 (1.2) | 179 (1.3) |
| I18V/G29W/L63P/S72G/L98Q/Y105L | 110 | 4064 (0.9) | 797318 (1.1) | 1351 (0.8) | 0 (0.0) |
| G29W/L63P/S72G/L98Q/Y105L/L106I | 111 | 4303 (0.9) | 829524 (1.2) | 1474 (0.9) | 0 (0.0) |
| G29W/L63P/I67V/S72G/L98Q/Y105L | 112 | 3993 (0.8) | 769557 (1.1) | 1053 (0.6) | 0 (0.0) |
| G29W/M55V/E59G/L63P/L98Q/Y105L | 113 | 4174 (0.9) | 427427 (0.6) | 1248 (0.7) | 0 (0.0) |
| G29W/L63P/S72G/L98Q/Y105L/I117L | 114 | 3794 (0.8) | 502885 (0.7) | 1853 (1.1) | 0 (0.0) |
| L63P/S72G/L98Q/Y105L/L106I/I117L | 115 | 3811 (0.8) | 789352 (1.1) | 1885 (1.1) | 37 (0.3) |
| L12F/R16H/G29W/M56T/L98Q/Y105L | 116 | 6575 (1.4) | 919746 (1.3) | 2615 (1.6) | 0 (0.0) |
| L12P/G29W/L63P/S72G/L98Q/Y105L | 117 | 4012 (0.8) | 783049 (1.1) | 1001 (0.6) | 155 (1.1) |
| L12P/G29W/L63P/S72G/L98Q/Y105L/L106I | 118 | 4347 (0.9) | 662327 (0.9) | 1219 (0.7) | 195 (1.4) |
| G29W/L63P/S72G/L98Q/Y105L/L106I/I117L | 119 | 3242 (0.7) | 702231 (1.0) | 1205 (0.7) | 133 (0.9) |
| A26T/T53S/L63P/L98Q/Y105L/L106I/I117L | 121 | 4853 (1.0) | 713974 (1.0) | 2111 (1.3) | 0 (0.0) |
| G29W/N58S/L63P/S72G/M87V/L98Q/Y105L | 122 | 4044 (0.8) | 818528 (1.2) | 1572 (0.9) | 0 (0.0) |
| G29W/S72G/Q76R/L98Q/Y105L/L106I/Q113H | 123 | 2421 (0.5) | 842313 (1.2) | 2147 (1.3) | 1129 (8.1) |
| G29W/N58S/L63P/S72G/L98Q/Y105L/L106V | 124 | 1233 (0.3) | 931184 (1.3) | 1045 (0.6) | 844 (6.0) |
| A26T/L63P/L98Q/M99L/Y105L | 125 | 3095 (0.6) | 762915 (1.1) | 1863 (1.1) | 1059 (7.6) |
| G29W/N58D/I67V/L98Q/M99L/Y105L | 126 | 2460 (0.5) | 898877 (1.3) | 4222 (2.5) | 373 (2.7) |
| I67V/S72G/Q82H/T89A/L98Q/M99L/Y105L | 127 | 1729 (0.4) | 865295 (1.2) | 5692 (3.4) | 786 (5.6) |
| S72G/R85G/L98Q/M99L/Y105L/L106I | 128 | 1439 (0.3) | 905813 (1.3) | 4653 (2.8) | 915 (6.5) |
| L63P/L98Q/M99L/Y105L | 81 | 2787 (0.6) | 824331 (1.2) | 1723 (1.0) | 692 (4.9) |
| A26T/T47A/M56K/L63P/S72G/Q82R/L98Q/M99L/Y105L | 129 | 2432 (0.5) | 835548 (1.2) | 2767 (1.7) | 404 (2.9) |
| A26T/M55T/L63P/S72G/L98Q/M99L/Y105L | 130 | 3226 (0.7) | 1085961 (1.5) | 2090 (1.3) | 1413 (10.1) |
| L12H/I18V/A42T/M55T/N58D/L98R/Y105L/L106I/P121S | 131 | 1764 (0.4) | 896733 (1.3) | 733 (0.4) | 170 (1.2) |
| I18T/A26T/L63P/S72G/L98Q/Y105L | 132 | 3265 (0.7) | 769820 (1.1) | 802 (0.5) | 145 (1.0) |

TABLE 7-continued

Binding and bioactivity of variant CTLA-4-Fc polypeptides

| Mutations | SEQ ID NO (ECD) | Binding CD80 MFI (Δ WT) | Binding CD86 MFI (Δ WT) | Binding ICOSL MFI (Δ WT) | MLR IFN-γ [pg/mL] (Δ WT) |
|---|---|---|---|---|---|
| L12F/K30R/S72G/Q82R/L98Q/M99L/Y105L | 133 | 1208 (0.3) | 766257 (1.1) | 1747 (1.0) | 718 (5.1) |
| L12P/L63P/S72G/L98Q/M99L/Y105L/L106N/I117L | 134 | 987 (0.2) | 782940 (1.1) | 998 (0.6) | 623 (4.4) |
| G29W/M87K/I93V/L98Q/M99L/Y105L | 135 | 2019 (0.4) | 767081 (1.1) | 7975 (4.8) | 786 (5.6) |
| P28L/E33V/L63P/S72G/L98Q/M99L/Y105L | 136 | 1163 (0.2) | 798068 (1.1) | 1849 (1.1) | 1161 (8.3) |
| G29W/T53S/M56K/L63P/Q82H/L98Q/M99I/Y105L | 137 | 4087 (0.9) | 425068 (0.6) | 5654 (3.4) | 956 (6.8) |
| I18F/L63P/L98Q/M99L/Y105L/P121S | 138 | 2392 (0.5) | 486401 (0.7) | 1765 (1.1) | 737 (5.3) |
| L63P/L98Q/M99L/Y105L/I108V | 139 | 3455 (0.7) | 730161 (1.0) | 2074 (1.2) | 592 (4.2) |
| A26T/A42V/Q45H/I67N/M87K/E97Q/M99L | 140 | 10573 (2.2) | 610530 (0.9) | 24030 (14.4) | 1282 (9.1) |
| E33M/L63P/S72G/L98Q/Y105L | 85 | 1984 (0.4) | 933740 (1.3) | 2401 (1.4) | 1849 (13.2) |
| M56V/E59G/L63P/S72G/M87K/I93V/L98Q/M99L/Y105L/I117E | 141 | 1940 (0.4) | 758136 (1.1) | 1552 (0.9) | 332 (2.4) |
| G29W/M87K/T895/L98Q/M99L/Y105L/I108V/I117L | 142 | 3525 (0.7) | 913043 (1.3) | 9533 (5.7) | 232 (1.7) |
| L12P/M56V/L63P/V96I/L98Q/M99L/Y105L/Y115H | 143 | 1647 (0.3) | 891092 (1.3) | 1059 (0.6) | 907 (6.5) |
| G29W/T53S/M56K/T61N/L63P/L98Q/Y105L | 144 | 3375 (0.7) | 919607 (1.3) | 1454 (0.9) | 0 (0.0) |
| I18T/A26S/M55T/M56V/L63P/S72G/L98Q/M99L/Y105L/I117K | 145 | 2455 (0.5) | 782684 (1.1) | 1686 (1.0) | 530 (3.8) |
| I18T/T61R/L63P/S72G/L98Q/M99L/Y105L | 146 | 3315 (0.7) | 926617 (1.3) | 2390 (1.4) | 296 (2.1) |
| L12P/L63P/S72G/L98Q/M99L/Y105L | 147 | 1784 (0.4) | 1045369 (1.5) | 1510 (0.9) | 968 (6.9) |
| E33M/L63P/S72G/L98Q/Y105L/I108F | 148 | 1481 (0.3) | 820016 (1.2) | 2109 (1.3) | 766 (5.5) |
| L12P/R16H/A26T/T61S/L63P/M87V/L98Q/M99L/Y105L/L106I/I117L | 149 | 1926 (0.4) | 895016 (1.3) | 1046 (0.6) | 593 (4.2) |
| G29W/T53S/M56K/N58S/L63P/M87V/L98Q/Y105L/P121S | 150 | 7819 (1.6) | 778254 (1.1) | 2249 (1.4) | 0 (0.0) |
| G29W/L63P/S72G/L98Q/Y105L/P121S | 151 | 3395 (0.7) | 763120 (1.1) | 1559 (0.9) | 0 (0.0) |
| G29W/T53S/M56K/N58S/L63P/M87V/L98Q/Y105L | 152 | 8116 (1.7) | 257214 (0.4) | 2517 (1.5) | 0 (0.0) |
| G29W/T53S/M56K/N58S/L63P/M87V/L98Q/Y105L/I108V | 153 | 7775 (1.6) | 271930 (0.4) | 3703 (2.2) | 45 (0.3) |
| G29W/T53S/L63P/S72G/L98Q/Y105L | 154 | 4497 (0.9) | 174601 (0.2) | 1545 (0.9) | 0 (0.0) |
| V10A/G29W/T53S/M56K/L63P/L98Q/Y105L/P121S | 155 | 6058 (1.3) | 766570 (1.1) | 1612 (1.0) | 0 (0.0) |
| WT CTLA4 | 2 | 4775 (1.0) | 708753 (1.0) | 1664 (1.0) | 140 (1.0) |

Example 7

Generation and Assay of CTLA-4 Consensus Variants

Additional variants of CTLA-4 ECD were designed by identifying consensus residues identified in the screen described in Examples 1-6 that were commonly associated with variants that exhibited improved CD80, CD86, and/or ICOSL binding and/or demonstrated suppression of interferon-gamma secretion in the MLR assay. The selected consensus mutations included I18T, A26T, E33V, T53S, M55T, M56K, N58S, L63P, M87V, L98Q, M99L, and Y105L. The consensus mutants were used to generate variant CTLA-4 ECDs by site-directed mutagenesis with reference to the wild-type sequence set forth in SEQ ID NO:2, which was then formatted as an Fc fusion protein as described in Example 4. The variant CTLA-4 ECD-Fc fusions were tested for binding and bioactivity as described below.

A. Binding and Bioactivity

1. Binding to Cell-Expressed Counter Structures

To produce cells expressing cognate binding partners, full-length mammalian surface expression constructs for each of human CD80, CD86, and ICOSL were designed in pcDNA3.1 expression vector (Life Technologies) and sourced from Genscript, USA. Binding studies were carried out using the Expi293F transient transfection system (Life Technologies, USA) described above. The number of cells needed for the experiment was determined, and the appropriate 30 mL scale of transfection was performed using the manufacturer's suggested protocol. For each counter structure or mock 30 mL transfection, 75 million Expi293F cells were incubated with 30 μg expression construct DNA and 1.5 mL diluted ExpiFectamine™ 293 reagent for 48 hours, at which point cells were harvested for staining.

In some instances, cells with stable expression of cognate binding partners were used. Chinese hamster ovarian cells (CHO) were stably transduced by lentivirus for surface expression of full-length human CD80, CD86, or ICOSL.

For flow cytometric analysis, 200,000 cells of a given transient transfection, stable cell line, or appropriate negative control were plated in 96 well round bottom plates. Cells were spun down and suspended in staining buffer (PBS (phosphate buffered saline), 1% BSA (bovine serum albumin), and 0.1% sodium azide) for 20 minutes to block non-specific binding. Afterwards, cells were centrifuged again and suspended in staining buffer containing 100 nM to 100 pM CTLA-4 variant Fc fusion protein or control in 50 μL. Primary staining was performed for 45 minutes, before washing cells in staining buffer twice. Bound CTLA-4 was detected with PE-conjugated anti-human IgG (Jackson ImmunoResearch, USA) diluted 1:150 in 50 μL staining buffer and incubated for 30 minutes. Alternatively, bound CTLA-4 was detected with anti-CTLA-4 antibody (Biolegend, USA) diluted 1:130 in 50 μL staining buffer for 30 minutes, before washing cells in staining buffer twice. Anti-CTLA-4 antibody was then detected with PE-conjugated anti-mouse IgG (Jackson ImmunoResearch, USA) diluted 1:150 in 50 μL staining buffer and incubated for 30 minutes.

After final incubation, cells were washed twice to remove unbound conjugated antibodies, fixed in 2% formaldehyde/PBS, and analyzed on a Hypercyt (Intellicyte, USA) or LSRII (Becton Dickinson, USA) flow cytometer.

Mean Fluorescence Intensity (MFI) was calculated for each sample with Cell Quest Pro software (Becton Dickinson, USA), FlowJo software (FlowJo, USA), or Forcyte software (Intellicyt, USA).

2. CD86 Blockade Bioassay

Select CTLA-4 variant Fc fusion proteins were assayed for capacity to block CD86-CD28 mediated costimulation as determined by a CD86 blockade bioassay. Artificial antigen presenting cells (APCs) were generated by transducing K562 cells with lentivirus to express cell surface anti-human CD3 single chain Fv (OKT3) and human CD86, yielding K562/OKT3/CD86. Effector cells were generated by transducing Jurkat cells expressing an IL-2-luciferace reporter (Promega) with lentivirus to express a chimeric receptor composed of the extracellular domain of human ICOS and the intracellular domain of human CD28, yielding Jurkat/IL-2/ICOS-CD28. APCs were plated in 33 μL/well of assay buffer (RPMI1640 with 5% FBS) at $2\times10^4$ cells/well with CTLA-4-Fc or control proteins in 33 μL/well at 300 nM. APCs and proteins were incubated for 20 minutes at room temperature before the addition of effector cells at $2\times10^5$ cell/well in 33 μL/well. The plates were transferred to a 37 degrees Celsius, humidified with 5% CO2 in an incubation chamber for 5 hours, then removed and allowed to acclimate to room temperature for 15 minutes. 100 μL/well of cell lysis and luciferase substrate solution (BioGlo™ luciferase reagent, Promega) was added to each plate and incubated on an orbital shaker for 10 minutes. Relative luminescence values (RLU) were determined for each test sample by measuring luminescence with a 1 second per well integration time using a Cytation 3 imaging reader (BioTek instruments). The percent inhibition mediated by CD86 blockade was determined using the following formula: [(Avg. Control RLU—Experimental RLU)/(Avg. Control RLU)]×100.

B. Results

The results are summarized below in Table 8. The values for binding CD80, CD86, and ICOSL (MFI) and percent inhibition CD28 costimulation are provided in addition to the relative ratio, as compared to the corresponding binding and CD86 blockade of the unmodified CTLA-4 polypeptide (ΔWT) for each experiment. As indicated, certain mutations and combinations of mutations were associated with a substantial increase in binding of CTLA-4 ECD to ICOSL, independent of the change in binding to either CD80 or CD86. In some cases, increases in binding to one or both of CD80 or CD86 also were observed.

TABLE 8

Binding and bioactivity of consensus variant CTLA-4-Fc polypeptides

| Mutations | SEQ ID NO (ECD) | Binding CD80 MFI (Δ WT) | CD86 MFI (Δ WT) | ICOSL MFI (Δ WT) | CD86 Blockade Bioassay (Δ WT) |
|---|---|---|---|---|---|
| T53S, M56K, N58S, L63P, M87V, L98Q, Y105L | 575 | 631192 (1.2) | 497901 (0.9) | 215054 (50.9) | 88.2 (1.3) |
| I18T, A26T, M55T, M56K, L63P, L98Q, M99L, Y105L | 576 | 759480 (1.4) | 657099 (1.1) | 89672 (21.2) | 40.2 (0.6) |
| I18T, A26T, M56K, L63P, L98Q, Y105L | 577 | 496119 (0.9) | 601631 (1.0) | 295395 (69.9) | 86.1 (1.2) |
| T53S, L63P, L98Q | 578 | 564111 (1.1) | 571155 (1.0) | 11541 (2.7) | 86.2 (1.2) |
| T53S, L63P, Y105L | 579 | 526605 (1.0) | 568901 (1.0) | 20739 (4.9) | 86.4 (1.2) |
| T53S, M56K, N58S, L63P, M87V, Y105L | 581 | 610377 (1.2) | 604604 (1.0) | 48034 (11.4) | 86.7 (1.3) |
| L98Q, M99L, Y105L | 60 | 875290 (1.7) | 686788 (1.2) | 116699 (27.6) | 33.9 (0.5) |
| E33V, L98Q, Y105L | 587 | 811261 (1.5) | 580048 (1.0) | 101877 (24.1) | 32.5 (0.5) |
| E33V, M99L | 590 | 758165 (1.4) | 618183 (1.1) | 71903 (17.0) | 85.2 (1.2) |
| T53S, M56K, N58S, L63P, M87V, L98Q | 580 | 347188 (0.7) | 555921 (1.0) | 7241 (1.7) | 82.6 (1.2) |
| T53S, M56K, N58S, L63P, L98Q, Y105L | 582 | 795550 (1.5) | 557059 (1.0) | 248668 (58.8) | 87.4 (1.3) |
| T53S, M56K, N58S, M87V, L98Q, Y105L | 583 | 1133587 (2.1) | 676071 (1.2) | 35087 (8.3) | 88.7 (1.3) |
| T53S, M56K, L63P, M87V, L98Q, Y105L | 584 | 736640 (1.4) | 546545 (0.9) | 234716 (55.5) | 90.1 (1.3) |
| T53S, N58S, L63P, M87V, L98Q, Y105L | 585 | 637509 (1.2) | 508878 (0.9) | 108784 (25.7) | 86.8 (1.3) |

TABLE 8-continued

Binding and bioactivity of consensus variant CTLA-4-Fc polypeptides

| Mutations | SEQ ID NO (ECD) | Binding: CD80 MFI (Δ WT) | Binding: CD86 MFI (Δ WT) | Binding: ICOSL MFI (Δ WT) | CD86 Blockade Bioassay (Δ WT) |
|---|---|---|---|---|---|
| M56K, N58S, L63P, M87V, L98Q, Y105L | 586 | 688049 (1.3) | 574298 (1.0) | 258574 (61.2) | 85.9 (1.2) |
| E33V, L98Q, M99L, | 589 | 975697 (1.8) | 628740 (1.1) | 137713 (32.6) | 14.1 (0.2) |
| Wild-type | 2 | 529140 (1.0) | 579615 (1.0) | 4228 (1.0) | 69.1 (1.0) |

Example 8

Generation and Assay of Select CTLA-4 Variants

A further panel of CTLA-4 ECD variants was designed with mutations from a variant CTLA-4 identified in the screen described in Examples 1-6, specifically the variant set forth in SEQ ID NO: 116 containing mutations L12F/R16H/G29W/M56T/L98Q/Y105L, which was associated with enhanced binding to CD80, CD86, and ICOSL and suppression of interferon-gamma. In some cases, S72G was included because it had been identified as a hot spot that had occurred in greater than 35% of the other top 50 hits that were identified as having suppressive activity. For some generated variants, the strategy included removal of some mutations (reversion mutations), for example, to reduce the number of mutations in the variant. Variant CTLA-4 ECDs were generated by site-directed mutagenesis with reference to the wild-type sequence set forth in SEQ ID NO:2, which was then formatted as an Fc fusion protein as described in Example 4. The variant CTLA-4 ECD-Fc fusions were tested for binding and bioactivity as described in Example 7.

Table 9 provides the values for binding CD80, CD86, and ICOSL (MFI) and percent inhibition CD28 costimulation in addition to the relative ratio, as compared to the corresponding binding and CD86 blockade of the unmodified CTLA-4 polypeptide (ΔWT) for each experiment.

TABLE 9

Binding and bioactivity of reversion variant CTLA-4-Fc polypeptides

| Mutations | SEQ ID NO (ECD) | Binding: CD80 MFI (Δ WT) | Binding: CD86 MFI (Δ WT) | Binding: ICOSL MFI (Δ WT) | MLR CD86 Blockade Bioassay (Δ WT) |
|---|---|---|---|---|---|
| L12F, R16H, G29W, M56T, L98Q | 591 | 76155 (1.5) | 86548 (1.2) | 959 (0.8) | 72.3 (0.9) |
| L12F, R16H, G29W, M56T, Y105L | 592 | 73996 (1.4) | 72293 (1.0) | 1944 (1.7) | 77.8 (1.0) |
| L12F, R16H, G29W, L98Q, Y105L | 593 | 60527 (1.2) | 78181 (1.1) | 862 (0.7) | 89.0 (1.1) |
| L12F, R16H, M56T, L98Q, Y105L | 594 | 70120 (1.4) | 70437 (1.0) | 1265 (1.1) | 86.8 (1.1) |
| G29W, M56T, L98Q, Y105L | 595 | 70579 (1.4) | 65251 (0.9) | 612 (0.5) | 88.6 (1.1) |
| L12F, G29W, L98Q, Y105L | 596 | 66677 (1.3) | 85018 (1.2) | 807 (0.7) | 90.0 (1.1) |
| L12F, L98Q, Y105L | 597 | 67142 (1.3) | 85125 (1.2) | 2584 (2.2) | 86.9 (1.1) |
| R16H, L98Q, Y105L | 598 | 67259 (1.3) | 70269 (1.0) | 1018 (0.9) | 89.8 (1.1) |
| G29W, L98Q, Y105L | 599 | 90170 (1.8) | 64097 (0.9) | 570 (0.5) | 90.0 (1.1) |
| M56T, L98Q, Y105L | 600 | 68644 (1.3) | 70222 (1.0) | 700 (0.6) | 88.0 (1.1) |
| L12F, R16H, G29W, M56T, S72G, L98Q, Y105L | 601 | 46175 (0.9) | 58464 (0.8) | 613 (0.5) | 88.3 (1.1) |
| G29W, M56T, S72G, L98Q, Y105L | 602 | 55706 (1.1) | 67962 (0.9) | 534 (0.5) | 88.6 (1.1) |
| Wild-type | 2 | 51269 (1.0) | 73502 (1.0) | 1160 (1.0) | 80.5 (1.0) |

Example 9

Collagen-Induced Arthritis Animal Study

An exemplary CTLA-4 ECD variant (G29W/N58S/L63P/Q82R/L98Q/Y105L; SEQ ID NO:93) fused to an Fc was assessed in a murine autoimmune model of rheumatoid arthritis. The activity in this model was compared to a fusion protein comprising the extracellular domain of CTLA-4 fused to an Fc (abatacept, sold under the brand Orencia®) and Fc alone.

On day 0, mice (male DBA/1J between 9 and 11 weeks old at start of study) were immobilized, their tails cleaned and injected by syringe between the dorsal and lateral vein with collagen/CFA emulsion. On day 18, mice were injected with a booster dose of collagen/IFA emulsion in a similar manner on the opposite side of the tail.

On day 18, mice (15 per group) received an intraperitoneal (IP) injection of 170 μg of the variant CTLA-4 ECD-Fc or abatacept, or received 112 μg of the Fc control. The IP injections were repeated on days 20, 22, and 26.

Mice were monitored every 2 days for signs of collagen-induced arthritis (CIA), starting 16 days after collagen/CFA immunization. CIA was scored for each paw on a scale of 0 to 4, wherein "0" was graded for a normal paw; "1" was graded for one inflamed and swollen toe on the paw; "2" was graded for more than one toe on a paw, but not the entire paw, inflamed and swollen or mild swelling of entire paw; "3" was graded for the entire paw inflamed and swollen; and 4 was graded when the entire paw was very inflamed and swollen or ankylosed (e.g., the mouse cannot grip the wire on a cage). The score for each paw was added up for a total CIA score for each mouse of between 0 and 16. The average total paw score for each treatment group is reported in FIG. 7.

Figure 7:
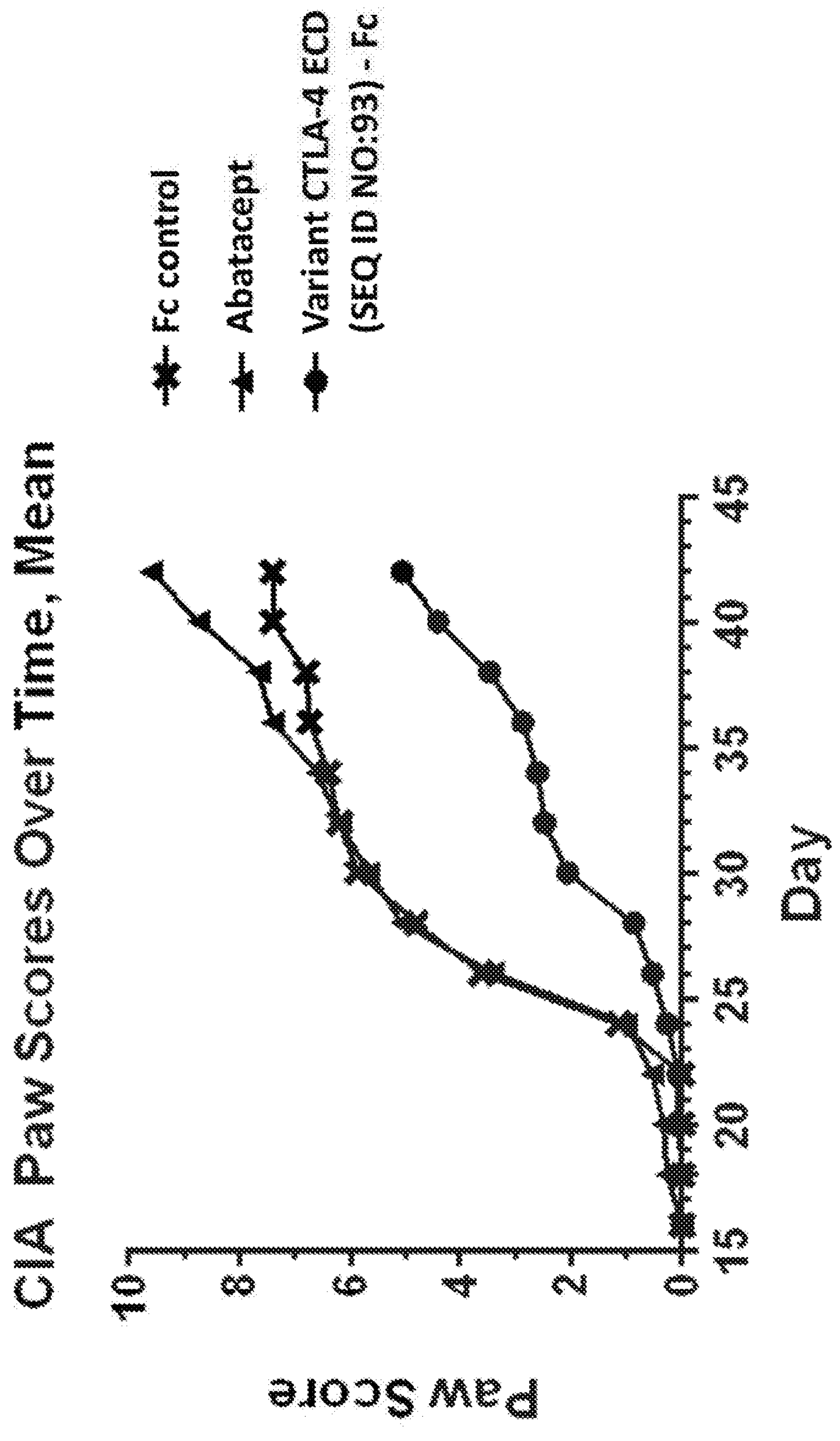
FIG. 7 depicts CIA paw score following treatment of mice in a collagen-induced arthritis (CIA) model with the exemplary CTLA-4 variant set forth in SEQ ID NO: 93 (containing mutations G29W/N58S/L63P/Q82R/L98Q/Y105L) fused to Fc, abatacept or an Fc control. CIA paw score was determined as the sum of each of four paws per mouse, and averaged across the group of 15 mice (mean CIA paw score).

As indicated in FIG. 7, the variant CTLA-4 ECD-Fc exhibited substantially reduced CIA compared to the other groups as shown by a delay in the development of CIA progression as determined by disease index score. These results are consistent with the variant CTLA-4 ECD-Fc exhibiting activity to block costimulatory signaling to modulate the immune response in this model in a manner that is potentially superior compared to clinical benchmark abatacept (sold under the brand Orencia®).

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (638 sequences)

SEQ ID NO: 1 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 2 - protein, 126 aa, Artificial Sequence [sequence omitted]

SEQ ID NO: 3 - protein, 102 aa, Artificial Sequence
  unmodified CTLA-4 IgV (39-140 of P16410)
HVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYY

SEQ ID NO: 4 - protein, 126 aa, Artificial Sequence
  L12P/A26T/L63P/L98Q/Y105L ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 5 - protein, 126 aa, Artificial Sequence
  L63P/L98R/N110K ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVERMYPPPYYLGIGKGTQIYVIDPEPCPDSD

SEQ ID NO: 6 - protein, 126 aa, Artificial Sequence
  L12P/A26T ECD
KAMHVAQPAVVPASSRGIASFVCEYTSPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSD

SEQ ID NO: 7 - protein, 126 aa, Artificial Sequence
  L12P/A26T/L63P ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSD

SEQ ID NO: 8 - protein, 126 aa, Artificial Sequence
  L63P/L98Q/Y105L ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 9 - protein, 126 aa, Artificial Sequence
  L98Q/Y105L ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 10 - protein, 126 aa, Artificial Sequence
  L63P ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSD

SEQ ID NO: 11 - protein, 126 aa, Artificial Sequence
  L98R/N110K ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVERMYPPPYYLGIGKGTQIYVIDPEPCPDSD

SEQ ID NO: 12 - protein, 126 aa, Artificial Sequence
  L12P/A26T/L63P/L98Q/M99L/Y105L ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 13 - protein, 126 aa, Artificial Sequence
  E33M/Q82H/L98Q/M99L/Y105L ECD
KAMHVAQPAVVLASSRGIASFVCEYASPGKATMVRVTVLRQADSQVTEVCAATYMMGNELTFLDDSICTGTSSGNQVNLTIHGLRAMDTGLYICKVEQLYPPPYLLGIGNGTQIYVIDPEPCPDSD

SEQ ID NO: 14 - protein, 126 aa, Artificial Sequence
  L63P/S72G/L98Q/M99L/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 15 - protein, 126 aa, Artificial Sequence
  S14N/R16C/I18T/M56K/T61A/L63P/A86T/M99L ECD
KAMHVAQPAVVLANSCGTASFVCEYASPGKATEVRVTVLRQADSQVTEVCAATYMKGNELAFPDDSICTGTSSGNQVNLTIQGLRTMDTGLYICKVELLYPPPYYLGIGNGTQIYVIDPEPCPDSD

SEQ ID NO: 16 - protein, 126 aa, Artificial Sequence
  S27P/M56K/L63P/S72G/S73R/T89A/M99L/Y105L/I117M ECD
KAMHVAQPAVVLASSRGIASFVCEYAPPGKATEVRVTVLRQADSQVTEVCAATYMKGNELTFPDDSICTGTGRGNQVNLTIQGLRAMDAGLYICKVELLYPPPYLLGIGNGTQIYVMDPEPCPDSD

SEQ ID NO: 17 - protein, 126 aa, Artificial Sequence
  M56K/L63P/N75D/V96I/M99L/Y105L/L106I ECD
KAMHVAQPAVVLASSRGIASFVCEYASPGKATEVRVTVLRQADSQVTEVCAATYMKGNELTFPDDSICTGTSSGDQVNLTIQGLRAMDTGLYICKIELLYPPPYLIGIGNGTQIYVIDPEPCPDSD

SEQ ID NO: 18 - protein, 126 aa, Artificial Sequence
  L63P/S72G/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVELMYPPPYLLGIGNGTQIYVIDPEPCPDSD

SEQ ID NO: 19 - protein, 126 aa, Artificial Sequence
  L63P/L98Q/M99L/Y105L/I117M ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVMDPEPCPDSD

SEQ ID NO: 20 - protein, 126 aa, Artificial Sequence
  L63P/S72G/L98Q/M99L/Y105L/L106I/I117L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLIGIGNGTQIYVLDPEPCPDSD

SEQ ID NO: 21 - protein, 126 aa, Artificial Sequence
  A26T/L63P/S72G/L98Q/Y105L/L106I/I117L ECD
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 22 - protein, 126 aa, Artificial Sequence
  L63P/L98Q/V116A ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYAIDPEPCPDSD

SEQ ID NO: 23 - protein, 126 aa, Artificial Sequence
  G29W/L98Q/M99L/Y105L ECD
KAMHVAQPAVVLASSRGIASFVCEYASPWKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSD

SEQ ID NO: 24 - protein, 126 aa, Artificial Sequence
  T37S/M56V/L98Q/Y105L ECD
KAMHVAQPAVVLASSRGIASFVCEYASPGKATEVRVSVLRQADSQVTEVCAATYMVGNELTFLDDSICTGTSSGNQVNLTIQGLRAMDTGLYICKVEQMYPPPYLLGIGNGTQIYVIDPEPCPDSD

SEQ ID NO: 25 - protein, 126 aa, Artificial Sequence
  A26T/Y54F/M56K/M99L/Y105L ECD
KAMHVAQPAVVLASSRGIASFVCEYTSPGKATEVRVTVLRQADSQVTEVCAATFMKGNELTFLDDSICTGTSSGNQVNLTIQGLRAMDTGLYICKVELLYPPPYLLGIGNGTQIYVIDPEPCPDSD

SEQ ID NO: 26 - protein, 126 aa, Artificial Sequence
  L12P/I18T/A26T/M55T/T69S/S72G/M99L/Y105L ECD
KAMHVAQPAVVPASSRGTASFVCEYTSPGKATEVRVTVLRQADSQVTEVCAATYTMGNELTFLDDSICSGTGSGNQVNLTIQGLRAMDTGLYICKVELLYPPPYLLGIGNGTQIYVIDPEPCPDSD

SEQ ID NO: 27 - protein, 126 aa, Artificial Sequence
  V22I/L63P/L98Q/Y105L/I117M ECD
KAMHVAQPAVVLASSRGIASFICEYASPGKATEVRVTVLRQADSQVTEVCAATYMMGNELTFPDDSICTGTSSGNQVNLTIQGLRAMDTGLYICKVEQMYPPPYLLGIGNGTQIYVMDPEPCPDSD

SEQ ID NO: 28 - protein, 126 aa, Artificial Sequence
  A26T/L63P/S72G/L98Q/M99L/Y105L ECD
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 29 - protein, 126 aa, Artificial Sequence
  E33M/A42T/L98Q/Y105L ECD
KAMHVAQPAVVLASSRGIASFVCEYASPGKATMVRVTVLRQTDSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 30 - protein, 126 aa, Artificial Sequence
  M55T/E97Q/M99L/Y105F ECD
KAMHVAQPAVVLASSRGIASFVCEYASPGKATEVRVTVLRQADSQVTEVCAATYTMGNELTFLDDSICTGTSSGNQVNLTIQGLRAMDTGLYICKVQLLYPPPYFLGIGNGTQIYVIDPEPCPDSD

SEQ ID NO: 31 - protein, 126 aa, Artificial Sequence
  M55T/S72G/L98Q/M99L/Y105L ECD
KAMHVAQPAVVLASSRGIASFVCEYASPGKATEVRVTVLRQADSQVTEVCAATYTMGNELTFLDDSICTGTGSGNQVNLTIQGLRAMDTGLYICKVEQLYPPPYLLGIGNGTQIYVIDPEPCPDSD

SEQ ID NO: 32 - protein, 126 aa, Artificial Sequence
  R16C/G29W/E33V/M55T/L63P/L98Q/Y105L ECD
KAMHVAQPAVVLASSCGIASFVCEYASPWKATVVRVTVLRQADSQVTEVCAATYTMGNELTFPDDSICTGTSSGNQVNLTIQGLRAMDTGLYICKVEQMYPPPYLLGIGNGTQIYVIDPEPCPDSD

SEQ ID NO: 33 - protein, 126 aa, Artificial Sequence
  L12P/A26T/L63P/L98Q/Y105L/L106I ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLIGIGNGTQIYVIDPEPCPDSD

SEQ ID NO: 34 - protein, 126 aa, Artificial Sequence
  M56L/L63P/L98Q/Y105L/L106I/I117L ECD
KAMHVAQPAVVLASSRGIASFVCEYASPGKATEVRVTVLRQADSQVTEVCAATYMLGNELTFPDDSICTGTSSGNQVNLTIQGLRAMDTGLYICKVEQMYPPPYLIGIGNGTQIYVLDPEPCPDSD

SEQ ID NO: 35 - protein, 126 aa, Artificial Sequence
  S15P/I18V/M56T/L98Q/M99L/Y105L ECD
KAMHVAQPAVVLASPRGVASFVCEYASPGKATEVRVTVLRQADSQVTEVCAATYMTGNELTFLDDSICTGTSSGNQVNLTIQGLRAMDTGLYICKVEQLYPPPYLLGIGNGTQIYVIDPEPCPDSD

SEQ ID NO: 36 - protein, 126 aa, Artificial Sequence
  I18T/G29W/L63P/L98Q/Y105L ECD
KAMHVAQPAVVLASSRGTASFVCEYASPWKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 37 - protein, 126 aa, Artificial Sequence
  L63P/Q82H/L98Q/M99L/Y105L ECD
KAMHVAQPAVVLASSRGIASFVCEYASPGKATEVRVTVLRQADSQVTEVCAATYMMGNELTFPDDSICTGTSSGNQVNLTIHGLRAMDTGLYICKVEQLYPPPYLLGIGNGTQIYVIDPEPCPDSD

SEQ ID NO: 38 - protein, 126 aa, Artificial Sequence
  L98Q/M99L/Y105L/L106I/I117T ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQIYVTDPEPCPDSD

SEQ ID NO: 39 - protein, 126 aa, Artificial Sequence
  L98Q/M99L/Y105L/L106I/Y115N ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQINVIDPEPCPDSD

SEQ ID NO: 40 - protein, 126 aa, Artificial Sequence
  M55T/L63P/T71I/M99L/Y105L ECD
KAMHVAQPAVVLASSRGIASFVCEYASPGKATEVRVTVLRQADSQVTEVCAATYTMGNELTFPDDSICTGISSGNQVNLTIQGLRAMDTGLYICKVELLYPPPYLLGIGNGTQIYVIDPEPCPDSD

SEQ ID NO: 41 - protein, 126 aa, Artificial Sequence
  A26T/T53S/M56K/L63P/L98Q/Y105L ECD
KAMHVAQPAVVLASSRGIASFVCEYTSPGKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSD

SEQ ID NO: 42 - protein, 126 aa, Artificial Sequence
  I18T/A26T/L63P/Q82R/L98Q/Y105L ECD
KAMHVAQPAVVLASSRGTASFVCEYTSPGKATEVRVTVLRQADSQVTEVCAATYMMGNELTFPDDSICTGTSSGNQVNLTIRGLRAMDTGLYICKVEQMYPPPYLLGIGNGTQIYVIDPEPCPDSD

SEQ ID NO: 43 - protein, 126 aa, Artificial Sequence
  L12H/M55T/E59D/L63P/M99L ECD
KAMHVAQPAVVHASSRGIASFVCEYASPGKATEVRVTVLRQADSQVTEVCAATYTMGNDLTFPDDSICTGTSSGNQVNLTIQGLRAMDTGLYICKVELLYPPPYYLGIGNGTQIYVIDPEPCPDSD

SEQ ID NO: 44 - protein, 126 aa, Artificial Sequence
  I18T/L63P/S72G/L98Q/Y105L/I108V ECD
KAMHVAQPAVVLASSRGTASFVCEYASPGKATEVRVTVLRQADSQVTEVCAATYMMGNELTFPDDSICTGTGSGNQVNLTIQGLRAMDTGLYICKVEQMYPPPYLLGVGNGTQIYVIDPEPCPDSD

SEQ ID NO: 45 - protein, 126 aa, Artificial Sequence [sequence omitted]

SEQ ID NO: 46 - protein, 126 aa, Artificial Sequence
  T61A/L63P/S72G/L98Q/M99L/Y105L ECD
KAMHVAQPAVVLASSRGIASFVCEYASPGKATEVRVTVLRQADSQVTEVCAATYMMGNELAFPDDSICTGTGSGNQVNLTIQGLRAMDTGLYICKVEQLYPPPYLLGIGNGTQIYVIDPEPCPDSD

SEQ ID NO: 47 - protein, 126 aa, Artificial Sequence
  V38I/L63P/S72G/L98Q/M99L/Y105L ECD
KAMHVAQPAVVLASSRGIASFVCEYASPGKATEVRVTILRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 48 - protein, 126 aa, Artificial Sequence
  L63P/S72G/I93L/L98Q/M99L/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYLCKVEQLYPPPYLLGIGNGTQIYVIDPEPCPDSD

SEQ ID NO: 49 - protein, 126 aa, Artificial Sequence
  L12I/M55T/M56V/I67T/M99L/L106R/I108F ECD
KAMHVAQPAVVIASSRGIASFVCEYASPGKATEVRVTVLRQADSQVTEVCAATYTVGNELTFLDDSTCTGTSSGNQVNLTIQGLRAMDTGLYICKVELLYPPPYYRGFGNGTQIYVIDPEPCPDSD

SEQ ID NO: 50 - protein, 126 aa, Artificial Sequence
  I18N/A26T/L63H/T89A/L98Q/M99L/Y105L ECD
KAMHVAQPAVVLASSRGNASFVCEYTSPGKATEVRVTVLRQADSQVTEVCAATYMMGNELTFHDDSICTGTSSGNQVNLTIQGLRAMDAGLYICKVEQLYPPPYLLGIGNGTQIYVIDPEPCPDSD

SEQ ID NO: 51 - protein, 126 aa, Artificial Sequence
  I18T/E48R/L63P/T69S/L98Q/Y105L/N110Y ECD
KAMHVAQPAVVLASSRGTASFVCEYASPGKATEVRVTVLRQADSQVTRVCAATYMMGNELTFPDDSICSGTSSGNQVNLTIQGLRAMDTGLYICKVEQMYPPPYLLGIGYGTQIYVIDPEPCPDSD

SEQ ID NO: 52 - protein, 126 aa, Artificial Sequence
  I18N/L63P/S72T/M87T/L98Q/Y105L/N110S ECD
KAMHVAQPAVVLASSRGNASFVCEYASPGKATEVRVTVLRQADSQVTEVCAATYMMGNELTFPDDSICTGTTSGNQVNLTIQGLRATDTGLYICKVEQMYPPPYLLGIGSGTQIYVIDPEPCPDSD

SEQ ID NO: 53 - protein, 126 aa, Artificial Sequence
  G29W/M56T/L63P/L98Q/Y105L/L106I/I117L ECD
KAMHVAQPAVVLASSRGIASFVCEYASPWKATEVRVTVLRQADSQVTEVCAATYMTGNELTFPDDSICTGTSSGNQVNLTIQGLRAMDTGLYICKVEQMYPPPYLIGIGNGTQIYVLDPEPCPDSD

SEQ ID NO: 54 - protein, 126 aa, Artificial Sequence
  G29W/N58S/L63P/M87T/L98Q/M99L/Y105L ECD
KAMHVAQPAVVLASSRGIASFVCEYASPWKATEVRVTVLRQADSQVTEVCAATYMMGSELTFPDDSICTGTSSGNQVNLTIQGLRATDTGLYICKVEQLYPPPYLLGIGNGTQIYVIDPEPCPDSD

SEQ ID NO: 55 - protein, 126 aa, Artificial Sequence
  G29W/N58S/L63P/D64N/L98Q/M99L/Y105L ECD
KAMHVAQPAVVLASSRGIASFVCEYASPWKATEVRVTVLRQADSQVTEVCAATYMMGSELTFPNDSICTGTSSGNQVNLTIQGLRAMDTGLYICKVEQLYPPPYLLGIGNGTQIYVIDPEPCPDSD

SEQ ID NO: 56 - protein, 126 aa, Artificial Sequence
  I18T/L63P/S72G/M87K/L98Q/M99L/Y105L ECD
KAMHVAQPAVVLASSRGTASFVCEYASPGKATEVRVTVLRQADSQVTEVCAATYMMGNELTFPDDSICTGTGSGNQVNLTIQGLRAKDTGLYICKVEQLYPPPYLLGIGNGTQIYVIDPEPCPDSD

SEQ ID NO: 57 - protein, 126 aa, Artificial Sequence
  M56V ECD
KAMHVAQPAVVLASSRGIASFVCEYASPGKATEVRVTVLRQADSQVTEVCAATYMVGNELTFLDDSICTGTSSGNQVNLTIQGLRAMDTGLYICKVELMYPPPYYLGIGNGTQIYVIDPEPCPDSD

SEQ ID NO: 58 - protein, 126 aa, Artificial Sequence
  L63P/K95R ECD
KAMHVAQPAVVLASSRGIASFVCEYASPGKATEVRVTVLRQADSQVTEVCAATYMMGNELTFPDDSICTGTSSGNQVNLTIQGLRAMDTGLYICRVELMYPPPYYLGIGNGTQIYVIDPEPCPDSD

SEQ ID NO: 59 - protein, 126 aa, Artificial Sequence
  L63P/L98Q ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYVIDPEPCPDSD

SEQ ID NO: 60 - protein, 126 aa, Artificial Sequence
  L98Q/M99L/Y105L ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSD

SEQ ID NO: 61 - protein, 126 aa, Artificial Sequence
  L63P/M87K/M99L/L106R ECD
KAMHVAQPAVVLASSRGIASFVCEYASPGKATEVRVTVLRQADSQVTEVCAATYMMGNELTFPDDSICTGTSSGNQVNLTIQGLRAKDTGLYICKVELLYPPPYYRGIGNGTQIYVIDPEPCPDSD

SEQ ID NO: 62 - protein, 126 aa, Artificial Sequence
  L63P/M99L/Y105L/I108F ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVELLYPPPYLLGFGNGTQIYVIDPEPCPDSD

SEQ ID NO: 63 - protein, 126 aa, Artificial Sequence
  V10A/L63P/L98Q/Y105L ECD
KAMHVAQPAAVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 64 - protein, 126 aa, Artificial Sequence
  M56T/L91R/L98Q/Y105L ECD
KAMHVAQPAVVLASSRGIASFVCEYASPGKATEVRVTVLRQADSQVTEVCAATYMTGNELTFLDDSICTGTSSGNQVNLTIQGLRAMDTGRYICKVEQMYPPPYLLGIGNGTQIYVIDPEPCPDSD

SEQ ID NO: 65 - protein, 126 aa, Artificial Sequence
  A26T/L63P/M87V/N110K/I117E ECD
KAMHVAQPAVVLASSRGIASFVCEYTSPGKATEVRVTVLRQADSQVTEVCAATYMMGNELTFPDDSICTGTSSGNQVNLTIQGLRAVDTGLYICKVELMYPPPYYLGIGKGTQIYVEDPEPCPDSD

SEQ ID NO: 66 - protein, 126 aa, Artificial Sequence
  G29W/L63P/L98Q/M99L/Y105L ECD
KAMHVAQPAVVLASSRGIASFVCEYASPWKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 67 - protein, 126 aa, Artificial Sequence
  A26T/V46E/L63P/D65G/L98Q ECD
KAMHVAQPAVVLASSRGIASFVCEYTSPGKATEVRVTVLRQADSQETEVCAATYMMGNELTFPDGSICTGTSSGNQVNLTIQGLRAMDTGLYICKVEQMYPPPYYLGIGNGTQIYVIDPEPCPDSD

SEQ ID NO: 68 - protein, 126 aa, Artificial Sequence
  G29W/N58S/L63P/L98Q/Y105L ECD
KAMHVAQPAVVLASSRGIASFVCEYASPWKATEVRVTVLRQADSQVTEVCAATYMMGSELTFPDDSICTGTSSGNQVNLTIQGLRAMDTGLYICKVEQMYPPPYLLGIGNGTQIYVIDPEPCPDSD

SEQ ID NO: 69 - protein, 126 aa, Artificial Sequence
  G29W/E59G/L63P/L98Q/Y105L ECD
KAMHVAQPAVVLASSRGIASFVCEYASPWKATEVRVTVLRQADSQVTEVCAATYMMGNGLTFPDDSICTGTSSGNQVNLTIQGLRAMDTGLYICKVEQMYPPPYLLGIGNGTQIYVIDPEPCPDSD

SEQ ID NO: 70 - protein, 126 aa, Artificial Sequence
  L12H/L63P/S72G/L98Q/Y105L ECD
KAMHVAQPAVVHASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 71 - protein, 126 aa, Artificial Sequence
  A6T/A26T/M55T/M99L/Y105L ECD
KAMHVTQPAVVLASSRGIASFVCEYTSPGKATEVRVTVLRQADSQVTEVCAATYTMGNELTFLDDSICTGTSSGNQVNLTIQGLRAMDTGLYICKVELLYPPPYLLGIGNGTQIYVIDPEPCPDSD

SEQ ID NO: 72 - protein, 126 aa, Artificial Sequence
  A26T/L63P/D65G/L98Q/M99L/Y105L ECD
KAMHVAQPAVVLASSRGIASFVCEYTSPGKATEVRVTVLRQADSQVTEVCAATYMMGNELTFPDGSICTGTSSGNQVNLTIQGLRAMDTGLYICKVEQLYPPPYLLGIGNGTQIYVIDPEPCPDSD

SEQ ID NO: 73 - protein, 126 aa, Artificial Sequence
  V10A/L63P/D64V/S72G/L98Q/M99L/Y105L ECD
KAMHVAQPAAVLASSRGIASFVCEYASPGKATEVRVTVLRQADSQVTEVCAATYMMGNELTFPVDSICTGTGSGNQVNLTIQGLRAMDTGLYICKVEQLYPPPYLLGIGNGTQIYVIDPEPCPDSD

SEQ ID NO: 74 - protein, 126 aa, Artificial Sequence
  L12P/G29W/D43N/N58S/L63P/L98Q/M99L/Y105L ECD
KAMHVAQPAVVPASSRGIASFVCEYASPWKATEVRVTVLRQANSQVTEVCAATYMMGSELTFPDDSICTGTSSGNQVNLTIQGLRAMDTGLYICKVEQLYPPPYLLGIGNGTQIYVIDPEPCPDSD

SEQ ID NO: 75 - protein, 126 aa, Artificial Sequence
  I18V/A26T/L63P/D64E/L98Q/Y105L/L106R/N110K ECD
KAMHVAQPAVVLASSRGVASFVCEYTSPGKATEVRVTVLRQADSQVTEVCAATYMMGNELTFPEDSICTGTSSGNQVNLTIQGLRAMDTGLYICKVEQMYPPPYLRGIGKGTQIYVIDPEPCPDSD

SEQ ID NO: 76 - protein, 126 aa, Artificial Sequence
  A19V/G29W/R35K/L63P/L98Q/M99L/Y105L ECD
KAMHVAQPAVVLASSRGIVSFVCEYASPWKATEVKVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 77 - protein, 126 aa, Artificial Sequence
  L12P/A26T/L63P/S72G/T89M/L98Q/M99L/Y105L ECD
KAMHVAQPAVVPASSRGIASFVCEYTSPGKATEVRVTVLRQADSQVTEVCAATYMMGNELTFPDDSICTGTGSGNQVNLTIQGLRAMDMGLYICKVEQLYPPPYLLGIGNGTQIYVIDPEPCPDSD

SEQ ID NO: 78 - protein, 126 aa, Artificial Sequence
  P28L/E33V/L63P/S72G/L98R/M99L/Y105L ECD
KAMHVAQPAVVLASSRGIASFVCEYASLGKATVVRVTVLRQADSQVTEVCAATYMMGNELTFPDDSICTGTGSGNQVNLTIQGLRAMDTGLYICKVERLYPPPYLLGIGNGTQIYVIDPEPCPDSD

SEQ ID NO: 79 - protein, 126 aa, Artificial Sequence
  E24Q/L63P/S72G/L98Q/M99L/Y105L ECD
KAMHVAQPAVVLASSRGIASFVCQYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 80 - protein, 126 aa, Artificial Sequence
  I18T/G29R/L63P/S72G/L98Q/M99L/Y105L ECD
KAMHVAQPAVVLASSRGTASFVCEYASPRKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 81 - protein, 126 aa, Artificial Sequence
  L63P/L98Q/M99L/Y105L ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 82 - protein, 126 aa, Artificial Sequence
  Q41L/Y54F/M56K/M99L/I108F ECD
KAMHVAQPAVVLASSRGIASFVCEYASPGKATEVRVTVLRLADSQVTEVCAATFMKGNELTFLDDSICTGTSSGNQVNLTIQGLRAMDTGLYICKVELLYPPPYYLGFGNGTQIYVIDPEPCPDSD

SEQ ID NO: 83 - protein, 126 aa, Artificial Sequence
  S72G/L98Q/M99L/Y105L/I117T ECD
KAMHVAQPAVVLASSRGIASFVCEYASPGKATEVRVTVLRQADSQVTEVCAATYMMGNELTFLDDSICTGTGSGNQVNLTIQGLRAMDTGLYICKVEQLYPPPYLLGIGNGTQIYVTDPEPCPDSD

SEQ ID NO: 84 - protein, 126 aa, Artificial Sequence
  M56R/L63P/L98Q/M99L/Y105L ECD
KAMHVAQPAVVLASSRGIASFVCEYASPGKATEVRVTVLRQADSQVTEVCAATYMRGNELTFPDDSICTGTSSGNQVNLTIQGLRAMDTGLYICKVEQLYPPPYLLGIGNGTQIYVIDPEPCPDSD

SEQ ID NO: 85 - protein, 126 aa, Artificial Sequence
  E33M/L63P/S72G/L98Q/Y105L ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 86 - protein, 126 aa, Artificial Sequence
  L63P/L98Q/M99L/Y105L/L106I ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLIGIGNGTQIYVIDPEPCPDSD

SEQ ID NO: 87 - protein, 126 aa, Artificial Sequence
  A26T/M55R/L98Q/M99L/Y105L ECD
KAMHVAQPAVVLASSRGIASFVCEYTSPGKATEVRVTVLRQADSQVTEVCAATYRMGNELTFLDDSICTGTSSGNQVNLTIQGLRAMDTGLYICKVEQLYPPPYLLGIGNGTQIYVIDPEPCPDSD

SEQ ID NO: 88 - protein, 126 aa, Artificial Sequence
  L63P/S72G/M87A/L98Q/Y105L ECD
KAMHVAQPAVVLASSRGIASFVCEYASPGKATEVRVTVLRQADSQVTEVCAATYMMGNELTFPDDSICTGTGSGNQVNLTIQGLRAADTGLYICKVEQMYPPPYLLGIGNGTQIYVIDPEPCPDSD

SEQ ID NO: 89 - protein, 126 aa, Artificial Sequence
  A26D/S72G/L98Q/M99L/Y105L ECD
KAMHVAQPAVVLASSRGIASFVCEYDSPGKATEVRVTVLRQADSQVTEVCAATYMMGNELTFLDDSICTGTGSGNQVNLTIQGLRAMDTGLYICKVEQLYPPPYLLGIGNGTQIYVIDPEPCPDSD

SEQ ID NO: 90 - protein, 126 aa, Artificial Sequence
  V22A/L63P/L98Q/M99L/Y105L/P119H ECD
KAMHVAQPAVVLASSRGIASFACEYASPGKATEVRVTVLRQADSQVTEVCAATYMMGNELTFPDDSICTGTSSGNQVNLTIQGLRAMDTGLYICKVEQLYPPPYLLGIGNGTQIYVIDHEPCPDSD

SEQ ID NO: 91 - protein, 126 aa, Artificial Sequence
  A26T/M55T/L63P/L98Q/M99L/Y105L ECD
KAMHVAQPAVVLASSRGIASFVCEYTSPGKATEVRVTVLRQADSQVTEVCAATYTMGNELTFPDDSICTGTSSGNQVNLTIQGLRAMDTGLYICKVEQLYPPPYLLGIGNGTQIYVIDPEPCPDSD

SEQ ID NO: 92 - protein, 126 aa, Artificial Sequence
  E33V/A42S/M55T/L98Q/M99L/Y105L ECD
KAMHVAQPAVVLASSRGIASFVCEYASPGKATVVRVTVLRQSDSQVTEVCAATYTMGNELTFLDDSICTGTSSGNQVNLTIQGLRAMDTGLYICKVEQLYPPPYLLGIGNGTQIYVIDPEPCPDSD

SEQ ID NO: 93 - protein, 126 aa, Artificial Sequence
  G29W/N58S/L63P/Q82R/L98Q/Y105L ECD
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSD

SEQ ID NO: 94 - protein, 126 aa, Artificial Sequence
  E33M/L63P/S72G/L98Q/Y105L/I117L ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVLDPEPCPDSD

SEQ ID NO: 95 - protein, 126 aa, Artificial Sequence
  A26T/I67N/S72G/L98Q/M99L/Y105L ECD
KAMHVAQPAVVLASSRGIASFVCEYTSPGKATEVRVTVLRQADSQVTEVCAATYMMGNELTFLDDSNCTGTGSGNQVNLTIQGLRAMDTGLYICKVEQLYPPPYLLGIGNGTQIYVIDPEPCPDSD

SEQ ID NO: 96 - protein, 126 aa, Artificial Sequence
  L12F/A26T/L63P/L98Q/Y105L/L106R ECD
KAMHVAQPAVVFASSRGIASFVCEYTSPGKATEVRVTVLRQADSQVTEVCAATYMMGNELTFPDDSICTGTSSGNQVNLTIQGLRAMDTGLYICKVEQMYPPPYLRGIGNGTQIYVIDPEPCPDSD

SEQ ID NO: 97 - protein, 126 aa, Artificial Sequence
  S20N/A26T/L63P/L98Q/M99L/Y105L ECD
KAMHVAQPAVVLASSRGIANFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 98 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 99 - protein, 126 aa, Artificial Sequence
  G29W/T61I/L63P/S72G/L98Q/M99L/Y105L ECD
KAMHVAQPAVVLASSRGIASFVCEYASPWKATEVRVTVLRQADSQVTEVCAATYMMGNELIFPDDSICTGTGSGNQVNLTIQGLRAMDTGLYICKVEQLYPPPYLLGIGNGTQIYVIDPEPCPDSD

SEQ ID NO: 100 - protein, 126 aa, Artificial Sequence
  G29W/N58S/L63P/T69I/L98Q/M99L/Y105L ECD
KAMHVAQPAVVLASSRGIASFVCEYASPWKATEVRVTVLRQADSQVTEVCAATYMMGSELTFPDDSICIGTSSGNQVNLTIQGLRAMDTGLYICKVEQLYPPPYLLGIGNGTQIYVIDPEPCPDSD

SEQ ID NO: 101 - protein, 126 aa, Artificial Sequence
  L12P/L63P/S72G/L98Q/M99L/Y105L/L106N ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVIDPEPCPDSD

SEQ ID NO: 102 - protein, 126 aa, Artificial Sequence
  L63P/T69A/L98Q/M99L/Y105L/L106R/V116A ECD
KAMHVAQPAVVLASSRGIASFVCEYASPGKATEVRVTVLRQADSQVTEVCAATYMMGNELTFPDDSICAGTSSGNQVNLTIQGLRAMDTGLYICKVEQLYPPPYLRGIGNGTQIYAIDPEPCPDSD

SEQ ID NO: 103 - protein, 126 aa, Artificial Sequence
  G29W/N58S/L63P/S72G/L98Q/Y105L ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLLGIGNGTQIYVIDPEPCPDSD

SEQ ID NO: 104 - protein, 126 aa, Artificial Sequence
  G29W/L63P/D65G/S72G/L98Q/Y105L ECD
KAMHVAQPAVVLASSRGIASFVCEYASPWKATEVRVTVLRQADSQVTEVCAATYMMGNELTFPDGSICTGTGSGNQVNLTIQGLRAMDTGLYICKVEQMYPPPYLLGIGNGTQIYVIDPEPCPDSD

SEQ ID NO: 105 - protein, 237 aa, Artificial Sequence
  enhanced green fluorescent protein (eEGFP)
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 106 - protein, 126 aa, Artificial Sequence
  T53S/M56V/L98Q/Y105L ECD
KAMHVAQPAVVLASSRGIASFVCEYASPGKATEVRVTVLRQADSQVTEVCAASYMVGNELTFLDDSICTGTSSGNQVNLTIQGLRAMDTGLYICKVEQMYPPPYLLGIGNGTQIYVIDPEPCPDSD

SEQ ID NO: 107 - protein, 126 aa, Artificial Sequence
  L63P/S72G/L98Q/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 108 - protein, 126 aa, Artificial Sequence
  I18A/L63P/S72G/L98Q/Y105L ECD
KAMHVAQPAVVLASSRGAASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 109 - protein, 126 aa, Artificial Sequence
  G29W/T53S/M56K/L63P/L98Q/Y105L ECD
KAMHVAQPAVVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSD

SEQ ID NO: 110 - protein, 126 aa, Artificial Sequence
  I18V/G29W/L63P/S72G/L98Q/Y105L ECD
KAMHVAQPAVVLASSRGVASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 111 - protein, 126 aa, Artificial Sequence
  G29W/L63P/S72G/L98Q/Y105L/L106I ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSD

SEQ ID NO: 112 - protein, 126 aa, Artificial Sequence
  G29W/L63P/I67V/S72G/L98Q/Y105L ECD
KAMHVAQPAVVLASSRGIASFVCEYASPWKATEVRVTVLRQADSQVTEVCAATYMMGNELTFPDDSVCTGTGSGNQVNLTIQGLRAMDTGLYICKVEQMYPPPYLLGIGNGTQIYVIDPEPCPDSD

SEQ ID NO: 113 - protein, 126 aa, Artificial Sequence
  G29W/M55V/E59G/L63P/L98Q/Y105L ECD
KAMHVAQPAVVLASSRGIASFVCEYASPWKATEVRVTVLRQADSQVTEVCAATYVMGNGLTFPDDSICTGTSSGNQVNLTIQGLRAMDTGLYICKVEQMYPPPYLLGIGNGTQIYVIDPEPCPDSD

SEQ ID NO: 114 - protein, 126 aa, Artificial Sequence
  G29W/L63P/S72G/L98Q/Y105L/I117L ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVLDPEPCPDSD

SEQ ID NO: 115 - protein, 126 aa, Artificial Sequence
  L63P/S72G/L98Q/Y105L/L106I/I117L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 116 - protein, 126 aa, Artificial Sequence
  L12F/R16H/G29W/M56T/L98Q/Y105L ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 117 - protein, 126 aa, Artificial Sequence
  L12P/G29W/L63P/S72G/L98Q/Y105L ECD
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 118 - protein, 126 aa, Artificial Sequence
  L12P/G29W/L63P/S72G/L98Q/Y105L/L106I ECD
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSD

SEQ ID NO: 119 - protein, 126 aa, Artificial Sequence
  G29W/L63P/S72G/L98Q/Y105L/L106I/I117L ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 120 - protein, 126 aa, Artificial Sequence
  G29W/N58S/L63P/S72G/L98Q/Y105L/L106I ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLIGIGNGTQIYVIDPEPCPDSD

SEQ ID NO: 121 - protein, 126 aa, Artificial Sequence
  A26T/T53S/L63P/L98Q/Y105L/L106I/I117L ECD
KAMHVAQPAVVLASSRGIASFVCEYTSPGKATEVRVTVLRQADSQVTEVCAASYMMGNELTFPDDSICTGTSSGNQVNLTIQGLRAMDTGLYICKVEQMYPPPYLIGIGNGTQIYVLDPEPCPDSD

SEQ ID NO: 122 - protein, 126 aa, Artificial Sequence
  G29W/N58S/L63P/S72G/M87V/L98Q/Y105L ECD
KAMHVAQPAVVLASSRGIASFVCEYASPWKATEVRVTVLRQADSQVTEVCAATYMMGSELTFPDDSICTGTGSGNQVNLTIQGLRAVDTGLYICKVEQMYPPPYLLGIGNGTQIYVIDPEPCPDSD

SEQ ID NO: 123 - protein, 126 aa, Artificial Sequence
  G29W/S72G/Q76R/L98Q/Y105L/L106I/Q113H ECD
KAMHVAQPAVVLASSRGIASFVCEYASPWKATEVRVTVLRQADSQVTEVCAATYMMGNELTFLDDSICTGTGSGNRVNLTIQGLRAMDTGLYICKVEQMYPPPYLIGIGNGTHIYVIDPEPCPDSD

SEQ ID NO: 124 - protein, 126 aa, Artificial Sequence
  G29W/N58S/L63P/S72G/L98Q/Y105L/L106V ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLVGIGNGTQIYVIDPEPCPDSD

SEQ ID NO: 125 - protein, 126 aa, Artificial Sequence
  A26T/L63P/L98Q/M99L/Y105L ECD
KAMHVAQPAVVLASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 126 - protein, 126 aa, Artificial Sequence
  G29W/N58D/I67V/L98Q/M99L/Y105L ECD
KAMHVAQPAVVLASSRGIASFVCEYASPWKATEVRVTVLRQADSQVTEVCAATYMMGDELTFLDDSVCTGTSSGNQVNLTIQGLRAMDTGLYICKVEQLYPPPYLLGIGNGTQIYVIDPEPCPDSD

SEQ ID NO: 127 - protein, 126 aa, Artificial Sequence
  I67V/S72G/Q82H/T89A/L98Q/M99L/Y105L ECD
KAMHVAQPAVVLASSRGIASFVCEYASPGKATEVRVTVLRQADSQVTEVCAATYMMGNELTFLDDSVCTGTGSGNQVNLTIHGLRAMDAGLYICKVEQLYPPPYLLGIGNGTQIYVIDPEPCPDSD

SEQ ID NO: 128 - protein, 126 aa, Artificial Sequence
  S72G/R85G/L98Q/M99L/Y105L/L106I ECD
KAMHVAQPAVVLASSRGIASFVCEYASPGKATEVRVTVLRQADSQVTEVCAATYMMGNELTFLDDSICTGTGSGNQVNLTIQGLGAMDTGLYICKVEQLYPPPYLIGIGNGTQIYVIDPEPCPDSD

SEQ ID NO: 129 - protein, 126 aa, Artificial Sequence
  A26T/T47A/M56K/L63P/S72G/Q82R/L98Q/M99L/Y105L ECD
KAMHVAQPAVVLASSRGIASFVCEYTSPGKATEVRVTVLRQADSQVAEVCAATYMKGNELTFPDDSICTGTGSGNQVNLTIRGLRAMDTGLYICKVEQLYPPPYLLGIGNGTQIYVIDPEPCPDSD

SEQ ID NO: 130 - protein, 126 aa, Artificial Sequence
  A26T/M55T/L63P/S72G/L98Q/M99L/Y105L ECD
KAMHVAQPAVVLASSRGIASFVCEYTSPGKATEVRVTVLRQADSQVTEVCAATYTMGNELTFPDDSICTGTGSGNQVNLTIQGLRAMDTGLYICKVEQLYPPPYLLGIGNGTQIYVIDPEPCPDSD

SEQ ID NO: 131 - protein, 126 aa, Artificial Sequence
  L12H/I18V/A42T/M55T/N58D/L98R/Y105L/L106I/P121S ECD
KAMHVAQPAVVHASSRGVASFVCEYASPGKATEVRVTVLRQTDSQVTEVCAATYTMGDELTFLDDSICTGTSSGNQVNLTIQGLRAMDTGLYICKVERMYPPPYLIGIGNGTQIYVIDPESCPDSD

SEQ ID NO: 132 - protein, 126 aa, Artificial Sequence
  I18T/A26T/L63P/S72G/L98Q/Y105L ECD
KAMHVAQPAVVLASSRGTASFVCEYTSPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 133 - protein, 126 aa, Artificial Sequence
  L12F/K30R/S72G/Q82R/L98Q/M99L/Y105L ECD
KAMHVAQPAVVFASSRGIASFVCEYASPGRATEVRVTVLRQADSQVTEVCAATYMMGNELTFLDDSICTGTGSGNQVNLTIRGLRAMDTGLYICKVEQLYPPPYLLGIGNGTQIYVIDPEPCPDSD

SEQ ID NO: 134 - protein, 126 aa, Artificial Sequence
  L12P/L63P/S72G/L98Q/M99L/Y105L/L106N/I117L ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVLDPEPCPDSD

SEQ ID NO: 135 - protein, 126 aa, Artificial Sequence
  G29W/M87K/I93V/L98Q/M99L/Y105L ECD
KAMHVAQPAVVLASSRGIASFVCEYASPWKATEVRVTVLRQADSQVTEVCAATYMMGNELTFLDDSICTGTSSGNQVNLTIQGLRAKDTGLYVCKVEQLYPPPYLLGIGNGTQIYVIDPEPCPDSD

SEQ ID NO: 136 - protein, 126 aa, Artificial Sequence
  P28L/E33V/L63P/S72G/L98Q/M99L/Y105L ECD
KAMHVAQPAVVLASSRGIASFVCEYASLGKATVVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 137 - protein, 126 aa, Artificial Sequence
  G29W/T53S/M56K/L63P/Q82H/L98Q/M99I/Y105L ECD
KAMHVAQPAVVLASSRGIASFVCEYASPWKATEVRVTVLRQADSQVTEVCAASYMKGNELTFPDDSICTGTSSGNQVNLTIHGLRAMDTGLYICKVEQIYPPPYLLGIGNGTQIYVIDPEPCPDSD

SEQ ID NO: 138 - protein, 126 aa, Artificial Sequence
  I18F/L63P/L98Q/M99L/Y105L/P121S ECD
KAMHVAQPAVVLASSRGFASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPESCPDSD

SEQ ID NO: 139 - protein, 126 aa, Artificial Sequence
  L63P/L98Q/M99L/Y105L/I108V ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGVGNGTQIYVIDPEPCPDSD

SEQ ID NO: 140 - protein, 126 aa, Artificial Sequence
  A26T/A42V/Q45H/I67N/M87K/E97Q/M99L ECD
KAMHVAQPAVVLASSRGIASFVCEYTSPGKATEVRVTVLRQVDSHVTEVCAATYMMGNELTFLDDSNCTGTSSGNQVNLTIQGLRAKDTGLYICKVQLLYPPPYYLGIGNGTQIYVIDPEPCPDSD

SEQ ID NO: 141 - protein, 126 aa, Artificial Sequence
  M56V/E59G/L63P/S72G/M87K/I93V/L98Q/M99L/Y105L/I117E ECD
KAMHVAQPAVVLASSRGIASFVCEYASPGKATEVRVTVLRQADSQVTEVCAATYMVGNGLTFPDDSICTGTGSGNQVNLTIQGLRAKDTGLYVCKVEQLYPPPYLLGIGNGTQIYVEDPEPCPDSD

SEQ ID NO: 142 - protein, 126 aa, Artificial Sequence
  G29W/M87K/T89S/L98Q/M99L/Y105L/I108V/I117L ECD
KAMHVAQPAVVLASSRGIASFVCEYASPWKATEVRVTVLRQADSQVTEVCAATYMMGNELTFLDDSICTGTSSGNQVNLTIQGLRAKDSGLYICKVEQLYPPPYLLGVGNGTQIYVLDPEPCPDSD

SEQ ID NO: 143 - protein, 126 aa, Artificial Sequence
  L12P/M56V/L63P/V96I/L98Q/M99L/Y105L/Y115H ECD
KAMHVAQPAVVPASSRGIASFVCEYASPGKATEVRVTVLRQADSQVTEVCAATYMVGNELTFPDDSICTGTSSGNQVNLTIQGLRAMDTGLYICKIEQLYPPPYLLGIGNGTQIHVIDPEPCPDSD

SEQ ID NO: 144 - protein, 126 aa, Artificial Sequence
  G29W/T53S/M56K/T61N/L63P/L98Q/Y105L ECD
KAMHVAQPAVVLASSRGIASFVCEYASPWKATEVRVTVLRQADSQVTEVCAASYMKGNELNFPDDSICTGTSSGNQVNLTIQGLRAMDTGLYICKVEQMYPPPYLLGIGNGTQIYVIDPEPCPDSD

SEQ ID NO: 145 - protein, 126 aa, Artificial Sequence
  I18T/A26S/M55T/M56V/L63P/S72G/L98Q/M99L/Y105L/I117K ECD
KAMHVAQPAVVLASSRGTASFVCEYSSPGKATEVRVTVLRQADSQVTEVCAATYTVGNELTFPDDSICTGTGSGNQVNLTIQGLRAMDTGLYICKVEQLYPPPYLLGIGNGTQIYVKDPEPCPDSD

SEQ ID NO: 146 - protein, 126 aa, Artificial Sequence
  I18T/T61R/L63P/S72G/L98Q/M99L/Y105L ECD
KAMHVAQPAVVLASSRGTASFVCEYASPGKATEVRVTVLRQADSQVTEVCAATYMMGNELRFPDDSICTGTGSGNQVNLTIQGLRAMDTGLYICKVEQLYPPPYLLGIGNGTQIYVIDPEPCPDSD

SEQ ID NO: 147 - protein, 126 aa, Artificial Sequence
  L12P/L63P/S72G/L98Q/M99L/Y105L ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 148 - protein, 126 aa, Artificial Sequence
  E33M/L63P/S72G/L98Q/Y105L/I108F ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGFGNGTQIYVIDPEPCPDSD

SEQ ID NO: 149 - protein, 126 aa, Artificial Sequence
  L12P/R16H/A26T/T61S/L63P/M87V/L98Q/M99L/Y105L/L106I/I117L ECD
KAMHVAQPAVVPASSHGIASFVCEYTSPGKATEVRVTVLRQADSQVTEVCAATYMMGNELSFPDDSICTGTSSGNQVNLTIQGLRAVDTGLYICKVEQLYPPPYLIGIGNGTQIYVLDPEPCPDSD

SEQ ID NO: 150 - protein, 126 aa, Artificial Sequence
  G29W/T53S/M56K/N58S/L63P/M87V/L98Q/Y105L/P121S ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPESCPDSD

SEQ ID NO: 151 - protein, 126 aa, Artificial Sequence
  G29W/L63P/S72G/L98Q/Y105L/P121S ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPESCPDSD

SEQ ID NO: 152 - protein, 126 aa, Artificial Sequence
  G29W/T53S/M56K/N58S/L63P/M87V/L98Q/Y105L ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPEPCPDSD

SEQ ID NO: 153 - protein, 126 aa, Artificial Sequence
  G29W/T53S/M56K/N58S/L63P/M87V/L98Q/Y105L/I108V ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGVGNGTQIYVIDPEPCPDSD

SEQ ID NO: 154 - protein, 126 aa, Artificial Sequence
  G29W/T53S/L63P/S72G/L98Q/Y105L ECD
KAMHVAQPAVVLASSRGIASFVCEYASPWKATEVRVTVLRQADSQVTEVCAASYMMGNELTFPDDSICTGTGSGNQVNLTIQGLRAMDTGLYICKVEQMYPPPYLLGIGNGTQIYVIDPEPCPDSD

SEQ ID NO: 155 - protein, 126 aa, Artificial Sequence
  V10A/G29W/T53S/M56K/L63P/L98Q/Y105L/P121S ECD
KAMHVAQPAAVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPESCPDSD

SEQ ID NO: 156 - protein, 102 aa, Artificial Sequence
  L12P/A26T/L63P/L98Q/Y105L IgV
HVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYL

SEQ ID NO: 157 - protein, 102 aa, Artificial Sequence
  L63P/L98R IgV domain (of L63P/L98R/N110K - IgV doesn't contain N110 residue)
HVAQPAVVLASSRGIASFVCEYASPGKATEVRVTVLRQADSQVTEVCAATYMMGNELTFPDDSICTGTSSGNQVNLTIQGLRAMDTGLYICKVERMYPPPYY

SEQ ID NO: 158 - protein, 102 aa, Artificial Sequence
  L12P/A26T IgV domain
HVAQPAVVPASSRGIASFVCEYTSPGKATEVRVTVLRQADSQVTEVCAATYMMGNELTFLDDSICTGTSSGNQVNLTIQGLRAMDTGLYICKVELMYPPPYY

SEQ ID NO: 159 - protein, 102 aa, Artificial Sequence
  L12P/A26T/L63P IgV domain
HVAQPAVVPASSRGIASFVCEYTSPGKATEVRVTVLRQADSQVTEVCAATYMMGNELTFPDDSICTGTSSGNQVNLTIQGLRAMDTGLYICKVELMYPPPYY

SEQ ID NO: 160 - protein, 102 aa, Artificial Sequence
  L63P/L98Q/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYL

SEQ ID NO: 161 - protein, 102 aa, Artificial Sequence
  L98Q/Y105L IgV domain
HVAQPAVVLASSRGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 162 - protein, 102 aa, Artificial Sequence
  L63P IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVELMYPPPYY

SEQ ID NO: 163 - protein, 102 aa, Artificial Sequence
  L98R IgV domain (of L98R/N110K - IgV doesn't contain N110 residue)
HVAQPAVVLASSRGIASFVCEYASPGKATEVRVTVLRQADSQVTEVCAATYMMGNELTFLDDSICTGTSSGNQVNLTIQGLRAMDTGLYICKVERMYPPPYY

SEQ ID NO: 164 - protein, 102 aa, Artificial Sequence
  L12P/A26T/L63P/L98Q/M99L/Y105L IgV domain
HVAQPAVVPASSRGIASFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 165 - protein, 102 aa, Artificial Sequence
  E33M/Q82H/L98Q/M99L/Y105L IgV domain
HVAQPAVVLASSRGIASFVCEYASPGKATMVRVTVLRQADSQVTEVCAATYMMGNELTFLDDSICTGTSSGNQVNLTIHGLRAMDTGLYICKVEQLYPPPYL

SEQ ID NO: 166 - protein, 102 aa, Artificial Sequence
  L63P/S72G/L98Q/M99L/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 167 - protein, 102 aa, Artificial Sequence
  S14N/R16C/I18T/M56K/T61A/L63P/A86T/M99L IgV domain
HVAQPAVVLANSCGTASFVCEYASPGKATEVRVTVLRQADSQVTEVCAATYMKGNELAFPDDSICTGTSSGNQVNLTIQGLRTMDTGLYICKVELLYPPPYY

SEQ ID NO: 168 - protein, 102 aa, Artificial Sequence
  S27P/M56K/L63P/S72G/S73R/T89A/M99L/Y105L IgV domain
HVAQPAVVLASSRGIASFVCEYAPPGKATEVRVTVLRQADSQVTEVCAATYMKGNELTFPDDSICTGTGRGNQVNLTIQGLRAMDAGLYICKVELLYPPPYL

SEQ ID NO: 169 - protein, 102 aa, Artificial Sequence
  M56K/L63P/N75D/V96I/M99L/Y105L IgV domain
HVAQPAVVLASSRGIASFVCEYASPGKATEVRVTVLRQADSQVTEVCAATYMKGNELTFPDDSICTGTSSGDQVNLTIQGLRAMDTGLYICKIELLYPPPYL

SEQ ID NO: 170 - protein, 102 aa, Artificial Sequence
  L63P/S72G/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVELMYPPPYL

SEQ ID NO: 171 - protein, 102 aa, Artificial Sequence
  A26T/L63P/S72G/L98Q/Y105L IgV domain
HVAQPAVVLASSRGIASFVCEYTSPGKATEVRVTVLRQADSQVTEVCAATYMMGNELTFPDDSICTGTGSGNQVNLTIQGLRAMDTGLYICKVEQMYPPPYL

SEQ ID NO: 172 - protein, 102 aa, Artificial Sequence
  G29W/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAMDTGLYICKVEQLYPPPYL

SEQ ID NO: 173 - protein, 102 aa, Artificial Sequence
  T37S/M56V/L98Q/Y105L IgV domain
HVAQPAVVLASSRGIASFVCEYASPGKATEVRVSVLRQADSQVTEVCAATYMVGNELTFLDDSICTGTSSGNQVNLTIQGLRAMDTGLYICKVEQMYPPPYL

SEQ ID NO: 174 - protein, 102 aa, Artificial Sequence
  A26T/Y54F/M56K/M99L/Y105L IgV domain
HVAQPAVVLASSRGIASFVCEYTSPGKATEVRVTVLRQADSQVTEVCAATFMKGNELTFLDDSICTGTSSGNQVNLTIQGLRAMDTGLYICKVELLYPPPYL

SEQ ID NO: 175 - protein, 102 aa, Artificial Sequence
  L12P/I18T/A26T/M55T/T69S/S72G/M99L/Y105L IgV domain
HVAQPAVVPASSRGTASFVCEYTSPGKATEVRVTVLRQADSQVTEVCAATYTMGNELTFLDDSICSGTGSGNQVNLTIQGLRAMDTGLYICKVELLYPPPYL

SEQ ID NO: 176 - protein, 102 aa, Artificial Sequence
  V22I/L63P/L98Q/Y105L IgV domain
HVAQPAVVLASSRGIASFICEYASPGKATEVRVTVLRQADSQVTEVCAATYMMGNELTFPDDSICTGTSSGNQVNLTIQGLRAMDTGLYICKVEQMYPPPYL

SEQ ID NO: 177 - protein, 102 aa, Artificial Sequence
  A26T/L63P/S72G/L98Q/M99L/Y105L IgV domain
HVAQPAVVLASSRGIASFVCEYTSPGKATEVRVTVLRQADSQVTEVCAATYMMGNELTFPDDSICTGTGSGNQVNLTIQGLRAMDTGLYICKVEQLYPPPYL

SEQ ID NO: 178 - protein, 102 aa, Artificial Sequence
  E33M/A42T/L98Q/Y105L IgV domain
HVAQPAVVLASSRGIASFVCEYASPGKATMVRVTVLRQTDSQVTEVCAATYMMGNELTFLDDSICTGTSSGNQVNLTIQGLRAMDTGLYICKVEQMYPPPYL

SEQ ID NO: 179 - protein, 102 aa, Artificial Sequence
  M55T/E97Q/M99L/Y105F IgV domain
HVAQPAVVLASSRGIASFVCEYASPGKATEVRVTVLRQADSQVTEVCAATYTMGNELTFLDDSICTGTSSGNQVNLTIQGLRAMDTGLYICKVQLLYPPPYF

SEQ ID NO: 180 - protein, 102 aa, Artificial Sequence
  M55T/S72G/L98Q/M99L/Y105L IgV domain
HVAQPAVVLASSRGIASFVCEYASPGKATEVRVTVLRQADSQVTEVCAATYTMGNELTFLDDSICTGTGSGNQVNLTIQGLRAMDTGLYICKVEQLYPPPYL

SEQ ID NO: 181 - protein, 102 aa, Artificial Sequence
  R16C/G29W/E33V/M55T/L63P/L98Q/Y105L IgV domain
HVAQPAVVLASSCGIASFVCEYASPWKATVVRVTVLRQADSQVTEVCAATYTMGNELTFPDDSICTGTSSGNQVNLTIQGLRAMDTGLYICKVEQMYPPPYL

SEQ ID NO: 182 - protein, 102 aa, Artificial Sequence
  M56L/L63P/L98Q/Y105L IgV domain
HVAQPAVVLASSRGIASFVCEYASPGKATEVRVTVLRQADSQVTEVCAATYMLGNELTFPDDSICTGTSSGNQVNLTIQGLRAMDTGLYICKVEQMYPPPYL

SEQ ID NO: 183 - protein, 102 aa, Artificial Sequence
  S15P/I18V/M56T/L98Q/M99L/Y105L IgV domain
HVAQPAVVLASPRGVASFVCEYASPGKATEVRVTVLRQADSQVTEVCAATYMTGNELTFLDDSICTGTSSGNQVNLTIQGLRAMDTGLYICKVEQLYPPPYL

SEQ ID NO: 184 - protein, 102 aa, Artificial Sequence
  I18T/G29W/L63P/L98Q/Y105L IgV domain
HVAQPAVVLASSRGTASFVCEYASPWKATEVRVTVLRQADSQVTEVCAATYMMGNELTFPDDSICTGTSSGNQVNLTIQGLRAMDTGLYICKVEQMYPPPYL

SEQ ID NO: 185 - protein, 102 aa, Artificial Sequence
  L63P/Q82H/L98Q/M99L/Y105L IgV domain
HVAQPAVVLASSRGIASFVCEYASPGKATEVRVTVLRQADSQVTEVCAATYMMGNELTFPDDSICTGTSSGNQVNLTIHGLRAMDTGLYICKVEQLYPPPYL

SEQ ID NO: 186 - protein, 102 aa, Artificial Sequence
  M55T/L63P/T71I/M99L/Y105L IgV domain
HVAQPAVVLASSRGIASFVCEYASPGKATEVRVTVLRQADSQVTEVCAATYTMGNELTFPDDSICTGISSGNQVNLTIQGLRAMDTGLYICKVELLYPPPYL

SEQ ID NO: 187 - protein, 102 aa, Artificial Sequence
  A26T/T53S/M56K/L63P/L98Q/Y105L IgV domain
HVAQPAVVLASSRGIASFVCEYTSPGKATEVRVTVLRQADSQVTEVCAASYMKGNELTFPDDSICTGTSSGNQVNLTIQGLRAMDTGLYICKVEQMYPPPYL

SEQ ID NO: 188 - protein, 102 aa, Artificial Sequence
  I18T/A26T/L63P/Q82R/L98Q/Y105L IgV domain
HVAQPAVVLASSRGTASFVCEYTSPGKATEVRVTVLRQADSQVTEVCAATYMMGNELTFPDDSICTGTSSGNQVNLTIRGLRAMDTGLYICKVEQMYPPPYL

SEQ ID NO: 189 - protein, 102 aa, Artificial Sequence
  L12H/M55T/E59D/L63P/M99L IgV domain
HVAQPAVVHASSRGIASFVCEYASPGKATEVRVTVLRQADSQVTEVCAATYTMGNDLTFPDDSICTGTSSGNQVNLTIQGLRAMDTGLYICKVELLYPPPYY

SEQ ID NO: 190 - protein, 102 aa, Artificial Sequence
  I18T/L63P/S72G/L98Q/Y105L IgV domain
HVAQPAVVLASSRGTASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 191 - protein, 102 aa, Artificial Sequence
  I18T/L63P/S72G/L98Q/M99L/Y105L IgV domain
HVAQPAVVLASSRGTASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 192 - protein, 102 aa, Artificial Sequence
  T61A/L63P/S72G/L98Q/M99L/Y105L IgV domain
HVAQPAVVLASSRGIASFVCEYASPGKATEVRVTVLRQADSQVTEVCAATYMMGNELAFPDDSICTGTGSGNQVNLTIQGLRAMDTGLYICKVEQLYPPPYL

SEQ ID NO: 193 - protein, 102 aa, Artificial Sequence
  V38I/L63P/S72G/L98Q/M99L/Y105L IgV domain
HVAQPAVVLASSRGIASFVCEYASPGKATEVRVTILRQADSQVTEVCAATYMMGNELTFPDDSICTGTGSGNQVNLTIQGLRAMDTGLYICKVEQLYPPPYL

SEQ ID NO: 194 - protein, 102 aa, Artificial Sequence
  L63P/S72G/I93L/L98Q/M99L/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYLCKVEQLYPPPYL

SEQ ID NO: 195 - protein, 102 aa, Artificial Sequence
  L12I/M55T/M56V/I67T/M99L IgV domain
HVAQPAVVIASSRGIASFVCEYASPGKATEVRVTVLRQADSQVTEVCAATYTVGNELTFLDDSTCTGTSSGNQVNLTIQGLRAMDTGLYICKVELLYPPPYY

SEQ ID NO: 196 - protein, 102 aa, Artificial Sequence
  I18N/A26T/L63H/T89A/L98Q/M99L/Y105L IgV domain
HVAQPAVVLASSRGNASFVCEYTSPGKATEVRVTVLRQADSQVTEVCAATYMMGNELTFHDDSICTGTSSGNQVNLTIQGLRAMDAGLYICKVEQLYPPPYL

SEQ ID NO: 197 - protein, 102 aa, Artificial Sequence
  I18T/E48R/L63P/T69S/L98Q/Y105L IgV domain
HVAQPAVVLASSRGTASFVCEYASPGKATEVRVTVLRQADSQVTRVCAATYMMGNELTFPDDSICSGTSSGNQVNLTIQGLRAMDTGLYICKVEQMYPPPYL

SEQ ID NO: 198 - protein, 102 aa, Artificial Sequence
  I18N/L63P/S72T/M87T/L98Q/Y105L IgV domain
HVAQPAVVLASSRGNASFVCEYASPGKATEVRVTVLRQADSQVTEVCAATYMMGNELTFPDDSICTGTTSGNQVNLTIQGLRATDTGLYICKVEQMYPPPYL

SEQ ID NO: 199 - protein, 102 aa, Artificial Sequence
  G29W/M56T/L63P/L98Q/Y105L IgV domain
HVAQPAVVLASSRGIASFVCEYASPWKATEVRVTVLRQADSQVTEVCAATYMTGNELTFPDDSICTGTSSGNQVNLTIQGLRAMDTGLYICKVEQMYPPPYL

SEQ ID NO: 200 - protein, 102 aa, Artificial Sequence
  G29W/N58S/L63P/M87T/L98Q/M99L/Y105L IgV domain
HVAQPAVVLASSRGIASFVCEYASPWKATEVRVTVLRQADSQVTEVCAATYMMGSELTFPDDSICTGTSSGNQVNLTIQGLRATDTGLYICKVEQLYPPPYL

SEQ ID NO: 201 - protein, 102 aa, Artificial Sequence
  G29W/N58S/L63P/D64N/L98Q/M99L/Y105L IgV domain
HVAQPAVVLASSRGIASFVCEYASPWKATEVRVTVLRQADSQVTEVCAATYMMGSELTFPNDSICTGTSSGNQVNLTIQGLRAMDTGLYICKVEQLYPPPYL

SEQ ID NO: 202 - protein, 102 aa, Artificial Sequence
  I18T/L63P/S72G/M87K/L98Q/M99L/Y105L IgV domain
HVAQPAVVLASSRGTASFVCEYASPGKATEVRVTVLRQADSQVTEVCAATYMMGNELTFPDDSICTGTGSGNQVNLTIQGLRAKDTGLYICKVEQLYPPPYL

SEQ ID NO: 203 - protein, 102 aa, Artificial Sequence
  M56V IgV domain
HVAQPAVVLASSRGIASFVCEYASPGKATEVRVTVLRQADSQVTEVCAATYMVGNELTFLDDSICTGTSSGNQVNLTIQGLRAMDTGLYICKVELMYPPPYY

SEQ ID NO: 204 - protein, 102 aa, Artificial Sequence
  L63P/K95R IgV domain
HVAQPAVVLASSRGIASFVCEYASPGKATEVRVTVLRQADSQVTEVCAATYMMGNELTFPDDSICTGTSSGNQVNLTIQGLRAMDTGLYICRVELMYPPPYY

SEQ ID NO: 205 - protein, 102 aa, Artificial Sequence
  L63P/L98Q IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYY

SEQ ID NO: 206 - protein, 102 aa, Artificial Sequence
  L98Q/M99L/Y105L IgV domain
HVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYL

SEQ ID NO: 207 - protein, 102 aa, Artificial Sequence
  L63P/M87K/M99L IgV domain
HVAQPAVVLASSRGIASFVCEYASPGKATEVRVTVLRQADSQVTEVCAATYMMGNELTFPDDSICTGTSSGNQVNLTIQGLRAKDTGLYICKVELLYPPPYY

SEQ ID NO: 208 - protein, 102 aa, Artificial Sequence
  L63P/M99L/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVELLYPPPYL

SEQ ID NO: 209 - protein, 102 aa, Artificial Sequence
  V10A/L63P/L98Q/Y105L IgV domain
HVAQPAAVLASSRGIASFVCEYASPGKATEVRVTVLRQADSQVTEVCAATYMMGNELTFPDDSICTGTSSGNQVNLTIQGLRAMDTGLYICKVEQMYPPPYL

SEQ ID NO: 210 - protein, 102 aa, Artificial Sequence
  M56T/L91R/L98Q/Y105L IgV domain
HVAQPAVVLASSRGIASFVCEYASPGKATEVRVTVLRQADSQVTEVCAATYMTGNELTFLDDSICTGTSSGNQVNLTIQGLRAMDTGRYICKVEQMYPPPYL

SEQ ID NO: 211 - protein, 102 aa, Artificial Sequence
  A26T/L63P/M87V IgV domain
HVAQPAVVLASSRGIASFVCEYTSPGKATEVRVTVLRQADSQVTEVCAATYMMGNELTFPDDSICTGTSSGNQVNLTIQGLRAVDTGLYICKVELMYPPPYY

SEQ ID NO: 212 - protein, 102 aa, Artificial Sequence
  G29W/L63P/L98Q/M99L/Y105L IgV domain
HVAQPAVVLASSRGIASFVCEYASPWKATEVRVTVLRQADSQVTEVCAATYMMGNELTFPDDSICTGTSSGNQVNLTIQGLRAMDTGLYICKVEQLYPPPYL

SEQ ID NO: 213 - protein, 102 aa, Artificial Sequence
  A26T/V46E/L63P/D65G/L98Q IgV domain
HVAQPAVVLASSRGIASFVCEYTSPGKATEVRVTVLRQADSQETEVCAATYMMGNELTFPDGSICTGTSSGNQVNLTIQGLRAMDTGLYICKVEQMYPPPYY

SEQ ID NO: 214 - protein, 102 aa, Artificial Sequence
  G29W/N58S/L63P/L98Q/Y105L IgV domain
HVAQPAVVLASSRGIASFVCEYASPWKATEVRVTVLRQADSQVTEVCAATYMMGSELTFPDDSICTGTSSGNQVNLTIQGLRAMDTGLYICKVEQMYPPPYL

SEQ ID NO: 215 - protein, 102 aa, Artificial Sequence
  G29W/E59G/L63P/L98Q/Y105L IgV domain
HVAQPAVVLASSRGIASFVCEYASPWKATEVRVTVLRQADSQVTEVCAATYMMGNGLTFPDDSICTGTSSGNQVNLTIQGLRAMDTGLYICKVEQMYPPPYL

SEQ ID NO: 216 - protein, 102 aa, Artificial Sequence
  L12H/L63P/S72G/L98Q/Y105L IgV domain
HVAQPAVVHASSRGIASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 217 - protein, 102 aa, Artificial Sequence
  A6T/A26T/M55T/M99L/Y105L IgV domain
HVTQPAVVLASSRGIASFVCEYTSPGKATEVRVTVLRQADSQVTEVCAATYTMGNELTFLDDSICTGTSSGNQVNLTIQGLRAMDTGLYICKVELLYPPPYL

SEQ ID NO: 218 - protein, 102 aa, Artificial Sequence
  A26T/L63P/D65G/L98Q/M99L/Y105L IgV domain
HVAQPAVVLASSRGIASFVCEYTSPGKATEVRVTVLRQADSQVTEVCAATYMMGNELTFPDGSICTGTSSGNQVNLTIQGLRAMDTGLYICKVEQLYPPPYL

SEQ ID NO: 219 - protein, 102 aa, Artificial Sequence
  V10A/L63P/D64V/S72G/L98Q/M99L/Y105L IgV domain
HVAQPAAVLASSRGIASFVCEYASPGKATEVRVTVLRQADSQVTEVCAATYMMGNELTFPVDSICTGTGSGNQVNLTIQGLRAMDTGLYICKVEQLYPPPYL

SEQ ID NO: 220 - protein, 102 aa, Artificial Sequence
  L12P/G29W/D43N/N58S/L63P/L98Q/M99L/Y105L IgV domain
HVAQPAVVPASSRGIASFVCEYASPWKATEVRVTVLRQANSQVTEVCAATYMMGSELTFPDDSICTGTSSGNQVNLTIQGLRAMDTGLYICKVEQLYPPPYL

SEQ ID NO: 221 - protein, 102 aa, Artificial Sequence
  I18V/A26T/L63P/D64E/L98Q/Y105L IgV domain
HVAQPAVVLASSRGVASFVCEYTSPGKATEVRVTVLRQADSQVTEVCAATYMMGNELTFPEDSICTGTSSGNQVNLTIQGLRAMDTGLYICKVEQMYPPPYL

SEQ ID NO: 222 - protein, 102 aa, Artificial Sequence
  A19V/G29W/R35K/L63P/L98Q/M99L/Y105L IgV domain
HVAQPAVVLASSRGIVSFVCEYASPWKATEVKVTVLRQADSQVTEVCAATYMMGNELTFPDDSICTGTSSGNQVNLTIQGLRAMDTGLYICKVEQLYPPPYL

SEQ ID NO: 223 - protein, 102 aa, Artificial Sequence
  L12P/A26T/L63P/S72G/T89M/L98Q/M99L/Y105L IgV domain
HVAQPAVVPASSRGIASFVCEYTSPGKATEVRVTVLRQADSQVTEVCAATYMMGNELTFPDDSICTGTGSGNQVNLTIQGLRAMDMGLYICKVEQLYPPPYL

SEQ ID NO: 224 - protein, 102 aa, Artificial Sequence
  P28L/E33V/L63P/S72G/L98R/M99L/Y105L IgV domain
HVAQPAVVLASSRGIASFVCEYASLGKATVVRVTVLRQADSQVTEVCAATYMMGNELTFPDDSICTGTGSGNQVNLTIQGLRAMDTGLYICKVERLYPPPYL

SEQ ID NO: 225 - protein, 102 aa, Artificial Sequence
  E24Q/L63P/S72G/L98Q/M99L/Y105L IgV domain
HVAQPAVVLASSRGIASFVCQYASPGKATEVRVTVLRQADSQVTEVCAATYMMGNELTFPDDSICTGTGSGNQVNLTIQGLRAMDTGLYICKVEQLYPPPYL

SEQ ID NO: 226 - protein, 102 aa, Artificial Sequence
  I18T/G29R/L63P/S72G/L98Q/M99L/Y105L IgV domain
HVAQPAVVLASSRGTASFVCEYASPRKATEVRVTVLRQADSQVTEVCAATYMMGNELTFPDDSICTGTGSGNQVNLTIQGLRAMDTGLYICKVEQLYPPPYL

SEQ ID NO: 227 - protein, 102 aa, Artificial Sequence
  L63P/L98Q/M99L/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYL

SEQ ID NO: 228 - protein, 102 aa, Artificial Sequence
  Q41L/Y54F/M56K/M99L IgV domain
HVAQPAVVLASSRGIASFVCEYASPGKATEVRVTVLRLADSQVTEVCAATFMKGNELTFLDDSICTGTSSGNQVNLTIQGLRAMDTGLYICKVELLYPPPYY

SEQ ID NO: 229 - protein, 102 aa, Artificial Sequence
  S72G/L98Q/M99L/Y105L IgV domain
HVAQPAVVLASSRGIASFVCEYASPGKATEVRVTVLRQADSQVTEVCAATYMMGNELTFLDDSICTGTGSGNQVNLTIQGLRAMDTGLYICKVEQLYPPPYL

SEQ ID NO: 230 - protein, 102 aa, Artificial Sequence
  M56R/L63P/L98Q/M99L/Y105L IgV domain
HVAQPAVVLASSRGIASFVCEYASPGKATEVRVTVLRQADSQVTEVCAATYMRGNELTFPDDSICTGTSSGNQVNLTIQGLRAMDTGLYICKVEQLYPPPYL

SEQ ID NO: 231 - protein, 102 aa, Artificial Sequence
  E33M/L63P/S72G/L98Q/Y105L IgV domain
HVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYL

SEQ ID NO: 232 - protein, 102 aa, Artificial Sequence
  A26T/M55R/L98Q/M99L/Y105L IgV domain
HVAQPAVVLASSRGIASFVCEYTSPGKATEVRVTVLRQADSQVTEVCAATYRMGNELTFLDDSICTGTSSGNQVNLTIQGLRAMDTGLYICKVEQLYPPPYL

SEQ ID NO: 233 - protein, 102 aa, Artificial Sequence
  L63P/S72G/M87A/L98Q/Y105L IgV domain
HVAQPAVVLASSRGIASFVCEYASPGKATEVRVTVLRQADSQVTEVCAATYMMGNELTFPDDSICTGTGSGNQVNLTIQGLRAADTGLYICKVEQMYPPPYL

SEQ ID NO: 234 - protein, 102 aa, Artificial Sequence
  A26D/S72G/L98Q/M99L/Y105L IgV domain
HVAQPAVVLASSRGIASFVCEYDSPGKATEVRVTVLRQADSQVTEVCAATYMMGNELTFLDDSICTGTGSGNQVNLTIQGLRAMDTGLYICKVEQLYPPPYL

SEQ ID NO: 235 - protein, 102 aa, Artificial Sequence
  V22A/L63P/L98Q/M99L/Y105L IgV domain
HVAQPAVVLASSRGIASFACEYASPGKATEVRVTVLRQADSQVTEVCAATYMMGNELTFPDDSICTGTSSGNQVNLTIQGLRAMDTGLYICKVEQLYPPPYL

SEQ ID NO: 236 - protein, 102 aa, Artificial Sequence
  A26T/M55T/L63P/L98Q/M99L/Y105L IgV domain
HVAQPAVVLASSRGIASFVCEYTSPGKATEVRVTVLRQADSQVTEVCAATYTMGNELTFPDDSICTGTSSGNQVNLTIQGLRAMDTGLYICKVEQLYPPPYL

SEQ ID NO: 237 - protein, 102 aa, Artificial Sequence
  E33V/A42S/M55T/L98Q/M99L/Y105L IgV domain
HVAQPAVVLASSRGIASFVCEYASPGKATVVRVTVLRQSDSQVTEVCAATYTMGNELTFLDDSICTGTSSGNQVNLTIQGLRAMDTGLYICKVEQLYPPPYL

SEQ ID NO: 238 - protein, 102 aa, Artificial Sequence
  G29W/N58S/L63P/Q82R/L98Q/Y105L IgV domain
HVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYL

SEQ ID NO: 239 - protein, 102 aa, Artificial Sequence
  A26T/I67N/S72G/L98Q/M99L/Y105L IgV domain
HVAQPAVVLASSRGIASFVCEYTSPGKATEVRVTVLRQADSQVTEVCAATYMMGNELTFLDDSNCTGTGSGNQVNLTIQGLRAMDTGLYICKVEQLYPPPYL

SEQ ID NO: 240 - protein, 102 aa, Artificial Sequence
  L12F/A26T/L63P/L98Q/Y105L IgV domain
HVAQPAVVFASSRGIASFVCEYTSPGKATEVRVTVLRQADSQVTEVCAATYMMGNELTFPDDSICTGTSSGNQVNLTIQGLRAMDTGLYICKVEQMYPPPYL

SEQ ID NO: 241 - protein, 102 aa, Artificial Sequence
  S20N/A26T/L63P/L98Q/M99L/Y105L IgV domain
HVAQPAVVLASSRGIANFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 242 - protein, 102 aa, Artificial Sequence
  G29W/M87K/T89S/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAKDSGLYICKVEQLYPPPYL

SEQ ID NO: 243 - protein, 102 aa, Artificial Sequence
  G29W/T61I/L63P/S72G/L98Q/M99L/Y105L IgV domain
HVAQPAVVLASSRGIASFVCEYASPWKATEVRVTVLRQADSQVTEVCAATYMMGNELIFPDDSICTGTGSGNQVNLTIQGLRAMDTGLYICKVEQLYPPPYL

SEQ ID NO: 244 - protein, 102 aa, Artificial Sequence
  G29W/N58S/L63P/T69I/L98Q/M99L/Y105L IgV domain
HVAQPAVVLASSRGIASFVCEYASPWKATEVRVTVLRQADSQVTEVCAATYMMGSELTFPDDSICIGTSSGNQVNLTIQGLRAMDTGLYICKVEQLYPPPYL

SEQ ID NO: 245 - protein, 102 aa, Artificial Sequence
  L12P/L63P/S72G/L98Q/M99L/Y105L IgV domain
HVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 246 - protein, 102 aa, Artificial Sequence
  L63P/T69A/L98Q/M99L/Y105L IgV domain
HVAQPAVVLASSRGIASFVCEYASPGKATEVRVTVLRQADSQVTEVCAATYMMGNELTFPDDSICAGTSSGNQVNLTIQGLRAMDTGLYICKVEQLYPPPYL

SEQ ID NO: 247 - protein, 102 aa, Artificial Sequence
  G29W/N58S/L63P/S72G/L98Q/Y105L IgV domain
HVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYL

SEQ ID NO: 248 - protein, 102 aa, Artificial Sequence
  G29W/L63P/D65G/S72G/L98Q/Y105L IgV domain
HVAQPAVVLASSRGIASFVCEYASPWKATEVRVTVLRQADSQVTEVCAATYMMGNELTFPDGSICTGTGSGNQVNLTIQGLRAMDTGLYICKVEQMYPPPYL

SEQ ID NO: 249 - protein, 102 aa, Artificial Sequence
  T53S/M56V/L98Q/Y105L IgV domain
HVAQPAVVLASSRGIASFVCEYASPGKATEVRVTVLRQADSQVTEVCAASYMVGNELTFLDDSICTGTSSGNQVNLTIQGLRAMDTGLYICKVEQMYPPPYL

SEQ ID NO: 250 - protein, 102 aa, Artificial Sequence
  L63P/S72G/L98Q/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 251 - protein, 102 aa, Artificial Sequence
  I18A/L63P/S72G/L98Q/Y105L IgV domain
HVAQPAVVLASSRGAASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 252 - protein, 102 aa, Artificial Sequence
  G29W/T53S/M56K/L63P/L98Q/Y105L IgV domain
HVAQPAVVLASSRGIASFVCEYASPWKATEVRVTVLRQADSQVTEVCAASYMKGNELTFPDDSICTGTSSGNQVNLTIQGLRAMDTGLYICKVEQMYPPPYL

SEQ ID NO: 253 - protein, 102 aa, Artificial Sequence
  I18V/G29W/L63P/S72G/L98Q/Y105L IgV domain
HVAQPAVVLASSRGVASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 254 - protein, 102 aa, Artificial Sequence
  G29W/L63P/S72G/L98Q/Y105L IgV domain
HVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 255 - protein, 102 aa, Artificial Sequence
  G29W/L63P/I67V/S72G/L98Q/Y105L IgV domain
HVAQPAVVLASSRGIASFVCEYASPWKATEVRVTVLRQADSQVTEVCAATYMMGNELTFPDDSVCTGTGSGNQVNLTIQGLRAMDTGLYICKVEQMYPPPYL

SEQ ID NO: 256 - protein, 102 aa, Artificial Sequence
  G29W/M55V/E59G/L63P/L98Q/Y105L IgV domain
HVAQPAVVLASSRGIASFVCEYASPWKATEVRVTVLRQADSQVTEVCAATYVMGNGLTFPDDSICTGTSSGNQVNLTIQGLRAMDTGLYICKVEQMYPPPYL

SEQ ID NO: 257 - protein, 102 aa, Artificial Sequence
  L12F/R16H/G29W/M56T/L98Q/Y105L IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYL

SEQ ID NO: 258 - protein, 102 aa, Artificial Sequence
  L12P/G29W/L63P/S72G/L98Q/Y105L IgV domain
HVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 259 - protein, 102 aa, Artificial Sequence
  A26T/T53S/L63P/L98Q/Y105L IgV domain
HVAQPAVVLASSRGIASFVCEYTSPGKATEVRVTVLRQADSQVTEVCAASYMMGNELTFPDDSICTGTSSGNQVNLTIQGLRAMDTGLYICKVEQMYPPPYL

SEQ ID NO: 260 - protein, 102 aa, Artificial Sequence
  G29W/N58S/L63P/S72G/M87V/L98Q/Y105L IgV domain
HVAQPAVVLASSRGIASFVCEYASPWKATEVRVTVLRQADSQVTEVCAATYMMGSELTFPDDSICTGTGSGNQVNLTIQGLRAVDTGLYICKVEQMYPPPYL

SEQ ID NO: 261 - protein, 102 aa, Artificial Sequence
  G29W/S72G/Q76R/L98Q/Y105L IgV domain
HVAQPAVVLASSRGIASFVCEYASPWKATEVRVTVLRQADSQVTEVCAATYMMGNELTFLDDSICTGTGSGNRVNLTIQGLRAMDTGLYICKVEQMYPPPYL

SEQ ID NO: 262 - protein, 102 aa, Artificial Sequence
  A26T/L63P/L98Q/M99L/Y105L IgV domain
HVAQPAVVLASSRGIASFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 263 - protein, 102 aa, Artificial Sequence
  G29W/N58D/I67V/L98Q/M99L/Y105L IgV domain
HVAQPAVVLASSRGIASFVCEYASPWKATEVRVTVLRQADSQVTEVCAATYMMGDELTFLDDSVCTGTSSGNQVNLTIQGLRAMDTGLYICKVEQLYPPPYL

SEQ ID NO: 264 - protein, 102 aa, Artificial Sequence
  I67V/S72G/Q82H/T89A/L98Q/M99L/Y105L IgV domain
HVAQPAVVLASSRGIASFVCEYASPGKATEVRVTVLRQADSQVTEVCAATYMMGNELTFLDDSVCTGTGSGNQVNLTIHGLRAMDAGLYICKVEQLYPPPYL

SEQ ID NO: 265 - protein, 102 aa, Artificial Sequence
  S72G/R85G/L98Q/M99L/Y105L IgV domain
HVAQPAVVLASSRGIASFVCEYASPGKATEVRVTVLRQADSQVTEVCAATYMMGNELTFLDDSICTGTGSGNQVNLTIQGLGAMDTGLYICKVEQLYPPPYL

SEQ ID NO: 266 - protein, 102 aa, Artificial Sequence
  A26T/T47A/M56K/L63P/S72G/Q82R/L98Q/M99L/Y105L IgV domain
HVAQPAVVLASSRGIASFVCEYTSPGKATEVRVTVLRQADSQVAEVCAATYMKGNELTFPDDSICTGTGSGNQVNLTIRGLRAMDTGLYICKVEQLYPPPYL

SEQ ID NO: 267 - protein, 102 aa, Artificial Sequence
  A26T/M55T/L63P/S72G/L98Q/M99L/Y105L IgV domain
HVAQPAVVLASSRGIASFVCEYTSPGKATEVRVTVLRQADSQVTEVCAATYTMGNELTFPDDSICTGTGSGNQVNLTIQGLRAMDTGLYICKVEQLYPPPYL

SEQ ID NO: 268 - protein, 102 aa, Artificial Sequence
  L12H/I18V/A42T/M55T/N58D/L98R/Y105L IgV domain
HVAQPAVVHASSRGVASFVCEYASPGKATEVRVTVLRQTDSQVTEVCAATYTMGDELTFLDDSICTGTSSGNQVNLTIQGLRAMDTGLYICKVERMYPPPYL

SEQ ID NO: 269 - protein, 102 aa, Artificial Sequence
  I18T/A26T/L63P/S72G/L98Q/Y105L IgV domain
HVAQPAVVLASSRGTASFVCEYTSPGKATEVRVTVLRQADSQVTEVCAATYMMGNELTFPDDSICTGTGSGNQVNLTIQGLRAMDTGLYICKVEQMYPPPYL

SEQ ID NO: 270 - protein, 102 aa, Artificial Sequence
  L12F/K30R/S72G/Q82R/L98Q/M99L/Y105L IgV domain
HVAQPAVVFASSRGIASFVCEYASPGRATEVRVTVLRQADSQVTEVCAATYMMGNELTFLDDSICTGTGSGNQVNLTIRGLRAMDTGLYICKVEQLYPPPYL

SEQ ID NO: 271 - protein, 102 aa, Artificial Sequence
  G29W/M87K/I93V/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAKDTGLYVCKVEQLYPPPYL

SEQ ID NO: 272 - protein, 102 aa, Artificial Sequence
  P28L/E33V/L63P/S72G/L98Q/M99L/Y105L IgV domain
HVAQPAVVLASSRGIASFVCEYASLGKATVVRVTVLRQADSQVTEVCAATYMMGNELTFPDDSICTGTGSGNQVNLTIQGLRAMDTGLYICKVEQLYPPPYL

SEQ ID NO: 273 - protein, 102 aa, Artificial Sequence
  G29W/T53S/M56K/L63P/Q82H/L98Q/M99I/Y105L IgV domain
HVAQPAVVLASSRGIASFVCEYASPWKATEVRVTVLRQADSQVTEVCAASYMKGNELTFPDDSICTGTSSGNQVNLTIHGLRAMDTGLYICKVEQIYPPPYL

SEQ ID NO: 274 - protein, 102 aa, Artificial Sequence
  I18F/L63P/L98Q/M99L/Y105L IgV domain
HVAQPAVVLASSRGFASFVCEYASPGKATEVRVTVLRQADSQVTEVCAATYMMGNELTFPDDSICTGTSSGNQVNLTIQGLRAMDTGLYICKVEQLYPPPYL

SEQ ID NO: 275 - protein, 102 aa, Artificial Sequence
  A26T/A42V/Q45H/I67N/M87K/E97Q/M99L IgV domain
HVAQPAVVLASSRGIASFVCEYTSPGKATEVRVTVLRQVDSHVTEVCAATYMMGNELTFLDDSNCTGTSSGNQVNLTIQGLRAKDTGLYICKVQLLYPPPYY

SEQ ID NO: 276 - protein, 102 aa, Artificial Sequence
  M56V/E59G/L63P/S72G/M87K/I93V/L98Q/M99L/Y105L IgV domain
HVAQPAVVLASSRGIASFVCEYASPGKATEVRVTVLRQADSQVTEVCAATYMVGNGLTFPDDSICTGTGSGNQVNLTIQGLRAKDTGLYVCKVEQLYPPPYL

SEQ ID NO: 277 - protein, 102 aa, Artificial Sequence
  L12P/M56V/L63P/V96I/L98Q/M99L/Y105L IgV domain
HVAQPAVVPASSRGIASFVCEYASPGKATEVRVTVLRQADSQVTEVCAATYMVGNELTFPDDSICTGTSSGNQVNLTIQGLRAMDTGLYICKIEQLYPPPYL

SEQ ID NO: 278 - protein, 102 aa, Artificial Sequence
  G29W/T53S/M56K/T61N/L63P/L98Q/Y105L IgV domain
HVAQPAVVLASSRGIASFVCEYASPWKATEVRVTVLRQADSQVTEVCAASYMKGNELNFPDDSICTGTSSGNQVNLTIQGLRAMDTGLYICKVEQMYPPPYL

SEQ ID NO: 279 - protein, 102 aa, Artificial Sequence
  I18T/A26S/M55T/M56V/L63P/S72G/L98Q/M99L/Y105L IgV domain
HVAQPAVVLASSRGTASFVCEYSSPGKATEVRVTVLRQADSQVTEVCAATYTVGNELTFPDDSICTGTGSGNQVNLTIQGLRAMDTGLYICKVEQLYPPPYL

SEQ ID NO: 280 - protein, 102 aa, Artificial Sequence
  I18T/T61R/L63P/S72G/L98Q/M99L/Y105L IgV domain
HVAQPAVVLASSRGTASFVCEYASPGKATEVRVTVLRQADSQVTEVCAATYMMGNELRFPDDSICTGTGSGNQVNLTIQGLRAMDTGLYICKVEQLYPPPYL

SEQ ID NO: 281 - protein, 102 aa, Artificial Sequence; identical to SEQ ID NO: 245
  L12P/L63P/S72G/L98Q/M99L/Y105L IgV domain

SEQ ID NO: 282 - protein, 102 aa, Artificial Sequence
  L12P/R16H/A26T/T61S/L63P/M87V/L98Q/M99L/Y105L IgV domain
HVAQPAVVPASSHGIASFVCEYTSPGKATEVRVTVLRQADSQVTEVCAATYMMGNELSFPDDSICTGTSSGNQVNLTIQGLRAVDTGLYICKVEQLYPPPYL

SEQ ID NO: 283 - protein, 102 aa, Artificial Sequence
  G29W/T53S/M56K/N58S/L63P/M87V/L98Q/Y105L IgV domain
HVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYL

SEQ ID NO: 284 - protein, 102 aa, Artificial Sequence
  G29W/T53S/L63P/S72G/L98Q/Y105L IgV domain
HVAQPAVVLASSRGIASFVCEYASPWKATEVRVTVLRQADSQVTEVCAASYMMGNELTFPDDSICTGTGSGNQVNLTIQGLRAMDTGLYICKVEQMYPPPYL

SEQ ID NO: 285 - protein, 102 aa, Artificial Sequence
  V10A/G29W/T53S/M56K/L63P/L98Q/Y105L IgV domain
HVAQPAAVLASSRGIASFVCEYASPWKATEVRVTVLRQADSQVTEVCAASYMKGNELTFPDDSICTGTSSGNQVNLTIQGLRAMDTGLYICKVEQMYPPPYL

SEQ ID NO: 286 - protein, 364 aa, Artificial Sequence
  L12P/A26T/L63P/L98Q/Y105L CTLA4-Fc
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - protein, 364 aa, Artificial Sequence
  L63P/L98R/N110K CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVERMYPPPYYLGIGKGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 364 aa, Artificial Sequence
  L12P/A26T CTLA4-Fc
KAMHVAQPAVVPASSRGIASFVCEYTSPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 289 - protein, 364 aa, Artificial Sequence
  L12P/A26T/L63P CTLA4-Fc
KAMHVAQPAVVPASSRGIASFVCEYTSPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 290 - protein, 364 aa, Artificial Sequence
  L63P/L98Q/Y105L CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 291 - protein, 364 aa, Artificial Sequence
  L98Q/Y105L CTLA4-Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 292 - protein, 364 aa, Artificial Sequence
  L63P CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 293 - protein, 364 aa, Artificial Sequence
  L98R/N110K CTLA4-Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVERMYPPPYYLGIGKGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 294 - protein, 364 aa, Artificial Sequence
  L12P/A26T/L63P/L98Q/M99L/Y105L CTLA4-Fc
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 295 - protein, 364 aa, Artificial Sequence
  E33M/Q82H/L98Q/M99L/Y105L CTLA4-Fc
KAMHVAQPAVVLASSRGIASFVCEYASPGKATMVRVTVLRQADSQVTEVCAATYMMGNELTFLDDSICTGTSSGNQVNLTIHGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 296 - protein, 364 aa, Artificial Sequence
  L63P/S72G/L98Q/M99L/Y105L CTLA4-Fc
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 297 - protein, 364 aa, Artificial Sequence
  S14N/R16C/I18T/M56K/T61A/L63P/A86T/M99L CTLA4-Fc
KAMHVAQPAVVLANSCGTASFVCEYASPGKATEVRVTVLRQADSQVTEVCAATYMKGNELAFPDDSICTGTSSGNQVNLTIQGLRTMDTGLYICKVELLYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 298 - protein, 364 aa, Artificial Sequence
  S27P/M56K/L63P/S72G/S73R/T89A/M99L/Y105L/I117M CTLA4-Fc
KAMHVAQPAVVLASSRGIASFVCEYAPPGKATEVRVTVLRQADSQVTEVCAATYMKGNELTFPDDSICTGTGRGNQVNLTIQGLRAMDAGLYICKVELLYPPPYLLGIGNGTQIYVMDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 299 - protein, 364 aa, Artificial Sequence
  M56K/L63P/N75D/V96I/M99L/Y105L/L106I CTLA4-Fc
KAMHVAQPAVVLASSRGIASFVCEYASPGKATEVRVTVLRQADSQVTEVCAATYMKGNELTFPDDSICTGTSSGDQVNLTIQGLRAMDTGLYICKIELLYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 300 - protein, 364 aa, Artificial Sequence
  L63P/S72G/Y105L CTLA4-Fc
KAMHVAQPAVVLASSRGIASFVCEYASPGKATEVRVTVLRQADSQVTEVCAATYMMGNELTFPDDSICTGTGSGNQVNLTIQGLRAMDTGLYICKVELMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 301 - protein, 364 aa, Artificial Sequence
  L63P/L98Q/M99L/Y105L/I117M CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVMDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 302 - protein, 364 aa, Artificial Sequence
  L63P/S72G/L98Q/M99L/Y105L/L106I/I117L CTLA4-Fc
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 303 - protein, 364 aa, Artificial Sequence
  A26T/L63P/S72G/L98Q/Y105L/L106I/I117L CTLA4-Fc
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 304 - protein, 364 aa, Artificial Sequence
  L63P/L98Q/V116A CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYAIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 305 - protein, 364 aa, Artificial Sequence
  G29W/L98Q/M99L/Y105L CTLA4-Fc
KAMHVAQPAVVLASSRGIASFVCEYASPWKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 306 - protein, 364 aa, Artificial Sequence
  T37S/M56V/L98Q/Y105L CTLA4-Fc
KAMHVAQPAVVLASSRGIASFVCEYASPGKATEVRVSVLRQADSQVTEVCAATYMVGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 307 - protein, 364 aa, Artificial Sequence
  A26T/Y54F/M56K/M99L/Y105L CTLA4-Fc
KAMHVAQPAVVLASSRGIASFVCEYTSPGKATEVRVTVLRQADSQVTEVCAATFMKGNELTFLDDSICTGTSSGNQVNLTIQGLRAMDTGLYICKVELLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 308 - protein, 364 aa, Artificial Sequence
  L12P/I18T/A26T/M55T/T69S/S72G/M99L/Y105L CTLA4-Fc
KAMHVAQPAVVPASSRGTASFVCEYTSPGKATEVRVTVLRQADSQVTEVCAATYTMGNELTFLDDSICSGTGSGNQVNLTIQGLRAMDTGLYICKVELLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 309 - protein, 364 aa, Artificial Sequence
  V22I/L63P/L98Q/Y105L/I117M CTLA4-Fc
KAMHVAQPAVVLASSRGIASFICEYASPGKATEVRVTVLRQADSQVTEVCAATYMMGNELTFPDDSICTGTSSGNQVNLTIQGLRAMDTGLYICKVEQMYPPPYLLGIGNGTQIYVMDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 310 - protein, 364 aa, Artificial Sequence
  A26T/L63P/S72G/L98Q/M99L/Y105L CTLA4-Fc
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 311 - protein, 364 aa, Artificial Sequence
  E33M/A42T/L98Q/Y105L CTLA4-Fc
KAMHVAQPAVVLASSRGIASFVCEYASPGKATMVRVTVLRQTDSQVTEVCAATYMMGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 312 - protein, 364 aa, Artificial Sequence
  M55T/E97Q/M99L/Y105F CTLA4-Fc
KAMHVAQPAVVLASSRGIASFVCEYASPGKATEVRVTVLRQADSQVTEVCAATYTMGNELTFLDDSICTGTSSGNQVNLTIQGLRAMDTGLYICKVQLLYPPPYFLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 313 - protein, 364 aa, Artificial Sequence
  M55T/S72G/L98Q/M99L/Y105L CTLA4-Fc
KAMHVAQPAVVLASSRGIASFVCEYASPGKATEVRVTVLRQADSQVTEVCAATYTMGNELTFLDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 314 - protein, 364 aa, Artificial Sequence
  R16C/G29W/E33V/M55T/L63P/L98Q/Y105L CTLA4-Fc
KAMHVAQPAVVLASSCGIASFVCEYASPWKATVVRVTVLRQADSQVTEVCAATYTMGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 315 - protein, 364 aa, Artificial Sequence
  L12P/A26T/L63P/L98Q/Y105L/L106I CTLA4-Fc
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 316 - protein, 364 aa, Artificial Sequence
  M56L/L63P/L98Q/Y105L/L106I/I117L CTLA4-Fc
KAMHVAQPAVVLASSRGIASFVCEYASPGKATEVRVTVLRQADSQVTEVCAATYMLGNELTFPDDSICTGTSSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 317 - protein, 364 aa, Artificial Sequence
  S15P/I18V/M56T/L98Q/M99L/Y105L CTLA4-Fc
KAMHVAQPAVVLASPRGVASFVCEYASPGKATEVRVTVLRQADSQVTEVCAATYMTGNELTFLDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 318 - protein, 364 aa, Artificial Sequence
  I18T/G29W/L63P/L98Q/Y105L CTLA4-Fc
KAMHVAQPAVVLASSRGTASFVCEYASPWKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 319 - protein, 364 aa, Artificial Sequence
  L63P/Q82H/L98Q/M99L/Y105L CTLA4-Fc
KAMHVAQPAVVLASSRGIASFVCEYASPGKATEVRVTVLRQADSQVTEVCAATYMMGNELTFPDDSICTGTSSGNQVNLTIHGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 320 - protein, 364 aa, Artificial Sequence
  L98Q/M99L/Y105L/L106I/I117T CTLA4-Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQIYVTDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 321 - protein, 364 aa, Artificial Sequence
  L98Q/M99L/Y105L/L106I/Y115N CTLA4-Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQINVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 322 - protein, 364 aa, Artificial Sequence
  M55T/L63P/T71I/M99L/Y105L CTLA4-Fc
KAMHVAQPAVVLASSRGIASFVCEYASPGKATEVRVTVLRQADSQVTEVCAATYTMGNELTFPDDSICTGISSGNQVNLTIQGLRAMDTGLYICKVELLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 323 - protein, 364 aa, Artificial Sequence
  A26T/T53S/M56K/L63P/L98Q/Y105L CTLA4-Fc
KAMHVAQPAVVLASSRGIASFVCEYTSPGKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 324 - protein, 364 aa, Artificial Sequence
  I18T/A26T/L63P/Q82R/L98Q/Y105L CTLA4-Fc
KAMHVAQPAVVLASSRGTASFVCEYTSPGKATEVRVTVLRQADSQVTEVCAATYMMGNELTFPDDSICTGTSSGNQVNLTIRGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 325 - protein, 364 aa, Artificial Sequence
  L12H/M55T/E59D/L63P/M99L CTLA4-Fc
KAMHVAQPAVVHASSRGIASFVCEYASPGKATEVRVTVLRQADSQVTEVCAATYTMGNDLTFPDDSICTGTSSGNQVNLTIQGLRAMDTGLYICKVELLYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 326 - protein, 364 aa, Artificial Sequence
  I18T/L63P/S72G/L98Q/Y105L/I108V CTLA4-Fc
KAMHVAQPAVVLASSRGTASFVCEYASPGKATEVRVTVLRQADSQVTEVCAATYMMGNELTFPDDSICTGTGSGNQVNLTIQGLRAMDTGLYICKVEQMYPPPYLLGVGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 327 - protein, 364 aa, Artificial Sequence
  I18T/L63P/S72G/L98Q/M99L/Y105L CTLA4-Fc
KAMHVAQPAVVLASSRGTASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 328 - protein, 364 aa, Artificial Sequence
  T61A/L63P/S72G/L98Q/M99L/Y105L CTLA4-Fc
KAMHVAQPAVVLASSRGIASFVCEYASPGKATEVRVTVLRQADSQVTEVCAATYMMGNELAFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 329 - protein, 364 aa, Artificial Sequence
  V38I/L63P/S72G/L98Q/M99L/Y105L CTLA4-Fc
KAMHVAQPAVVLASSRGIASFVCEYASPGKATEVRVTILRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 330 - protein, 364 aa, Artificial Sequence
  L63P/S72G/I93L/L98Q/M99L/Y105L CTLA4-Fc
KAMHVAQPAVVLASSRGIASFVCEYASPGKATEVRVTVLRQADSQVTEVCAATYMMGNELTFPDDSICTGTGSGNQVNLTIQGLRAMDTGLYLCKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 331 - protein, 364 aa, Artificial Sequence
  L12I/M55T/M56V/I67T/M99L/L106R/I108F CTLA4-Fc
KAMHVAQPAVVIASSRGIASFVCEYASPGKATEVRVTVLRQADSQVTEVCAATYTVGNELTFLDDSTCTGTSSGNQVNLTIQGLRAMDTGLYICKVELLYPPPYYRGFGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 332 - protein, 364 aa, Artificial Sequence
  I18N/A26T/L63H/T89A/L98Q/M99L/Y105L CTLA4-Fc
KAMHVAQPAVVLASSRGNASFVCEYTSPGKATEVRVTVLRQADSQVTEVCAATYMMGNELTFHDDSICTGTSSGNQVNLTIQGLRAMDAGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 333 - protein, 364 aa, Artificial Sequence
  I18T/E48R/L63P/T69S/L98Q/Y105L/N110Y CTLA4-Fc
KAMHVAQPAVVLASSRGTASFVCEYASPGKATEVRVTVLRQADSQVTRVCAATYMMGNELTFPDDSICSGTSSGNQVNLTIQGLRAMDTGLYICKVEQMYPPPYLLGIGYGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 334 - protein, 364 aa, Artificial Sequence
  I18N/L63P/S72T/M87T/L98Q/Y105L/N110S CTLA4-Fc
KAMHVAQPAVVLASSRGNASFVCEYASPGKATEVRVTVLRQADSQVTEVCAATYMMGNELTFPDDSICTGTTSGNQVNLTIQGLRATDTGLYICKVEQMYPPPYLLGIGSGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 335 - protein, 364 aa, Artificial Sequence
  G29W/M56T/L63P/L98Q/Y105L/L106I/I117L CTLA4-Fc
KAMHVAQPAVVLASSRGIASFVCEYASPWKATEVRVTVLRQADSQVTEVCAATYMTGNELTFPDDSICTGTSSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 336 - protein, 364 aa, Artificial Sequence
  G29W/N58S/L63P/M87T/L98Q/M99L/Y105L CTLA4-Fc
KAMHVAQPAVVLASSRGIASFVCEYASPWKATEVRVTVLRQADSQVTEVCAATYMMGSELTFPDDSICTGTSSGNQVNLTIQGLRATDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 337 - protein, 364 aa, Artificial Sequence
  G29W/N58S/L63P/D64N/L98Q/M99L/Y105L CTLA4-Fc
KAMHVAQPAVVLASSRGIASFVCEYASPWKATEVRVTVLRQADSQVTEVCAATYMMGSELTFPNDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 338 - protein, 364 aa, Artificial Sequence
  I18T/L63P/S72G/M87K/L98Q/M99L/Y105L CTLA4-Fc
KAMHVAQPAVVLASSRGTASFVCEYASPGKATEVRVTVLRQADSQVTEVCAATYMMGNELTFPDDSICTGTGSGNQVNLTIQGLRAKDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 339 - protein, 364 aa, Artificial Sequence
  M56V CTLA4-Fc
KAMHVAQPAVVLASSRGIASFVCEYASPGKATEVRVTVLRQADSQVTEVCAATYMVGNELTFLDDSICTGTSSGNQVNLTIQGLRAMDTGLYICKVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 340 - protein, 364 aa, Artificial Sequence
  L63P/K95R CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICRVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 341 - protein, 364 aa, Artificial Sequence
  L63P/L98Q CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 342 - protein, 364 aa, Artificial Sequence
  L98Q/M99L/Y105L CTLA4-Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 343 - protein, 364 aa, Artificial Sequence
  L63P/M87K/M99L/L106R CTLA4-Fc
KAMHVAQPAVVLASSRGIASFVCEYASPGKATEVRVTVLRQADSQVTEVCAATYMMGNELTFPDDSICTGTSSGNQVNLTIQGLRAKDTGLYICKVELLYPPPYYRGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 344 - protein, 364 aa, Artificial Sequence
  L63P/M99L/Y105L/I108F CTLA4-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVELLYPPPYLLGFGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 345 - protein, 364 aa, Artificial Sequence
  V10A/L63P/L98Q/Y105L CTLA4-Fc
KAMHVAQPAAVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 346 - protein, 364 aa, Artificial Sequence
  M56T/L91R/L98Q/Y105L CTLA4-Fc
KAMHVAQPAVVLASSRGIASFVCEYASPGKATEVRVTVLRQADSQVTEVCAATYMTGNELTFLDDSICTGTSSGNQVNLTIQGLRAMDTGRYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 347 - protein, 364 aa, Artificial Sequence
  A26T/L63P/M87V/N110K/I117E CTLA4-Fc
KAMHVAQPAVVLASSRGIASFVCEYTSPGKATEVRVTVLRQADSQVTEVCAATYMMGNELTFPDDSICTGTSSGNQVNLTIQGLRAVDTGLYICKVELMYPPPYYLGIGKGTQIYVEDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 348 - protein, 364 aa, Artificial Sequence
  G29W/L63P/L98Q/M99L/Y105L CTLA4-Fc
KAMHVAQPAVVLASSRGIASFVCEYASPWKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 349 - protein, 364 aa, Artificial Sequence
  A26T/V46E/L63P/D65G/L98Q CTLA4-Fc
KAMHVAQPAVVLASSRGIASFVCEYTSPGKATEVRVTVLRQADSQETEVCAATYMMGNELTFPDGSICTGTSSGNQVNLTIQGLRAMDTGLYICKVEQMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 350 - protein, 364 aa, Artificial Sequence
  G29W/N58S/L63P/L98Q/Y105L CTLA4-Fc
KAMHVAQPAVVLASSRGIASFVCEYASPWKATEVRVTVLRQADSQVTEVCAATYMMGSELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 351 - protein, 364 aa, Artificial Sequence
  G29W/E59G/L63P/L98Q/Y105L CTLA4-Fc
KAMHVAQPAVVLASSRGIASFVCEYASPWKATEVRVTVLRQADSQVTEVCAATYMMGNGLTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 352 - protein, 364 aa, Artificial Sequence
  L12H/L63P/S72G/L98Q/Y105L CTLA4-Fc
KAMHVAQPAVVHASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 353 - protein, 364 aa, Artificial Sequence
  A6T/A26T/M55T/M99L/Y105L CTLA4-Fc
KAMHVTQPAVVLASSRGIASFVCEYTSPGKATEVRVTVLRQADSQVTEVCAATYTMGNELTFLDDSICTGTSSGNQVNLTIQGLRAMDTGLYICKVELLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 354 - protein, 364 aa, Artificial Sequence
  A26T/L63P/D65G/L98Q/M99L/Y105L CTLA4-Fc
KAMHVAQPAVVLASSRGIASFVCEYTSPGKATEVRVTVLRQADSQVTEVCAATYMMGNELTFPDGSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 355 - protein, 364 aa, Artificial Sequence
  V10A/L63P/D64V/S72G/L98Q/M99L/Y105L CTLA4-Fc
KAMHVAQPAAVLASSRGIASFVCEYASPGKATEVRVTVLRQADSQVTEVCAATYMMGNELTFPVDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 356 - protein, 364 aa, Artificial Sequence
  L12P/G29W/D43N/N58S/L63P/L98Q/M99L/Y105L CTLA4-Fc
KAMHVAQPAVVPASSRGIASFVCEYASPWKATEVRVTVLRQANSQVTEVCAATYMMGSELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 357 - protein, 364 aa, Artificial Sequence
  I18V/A26T/L63P/D64E/L98Q/Y105L/L106R/N110K CTLA4-Fc
KAMHVAQPAVVLASSRGVASFVCEYTSPGKATEVRVTVLRQADSQVTEVCAATYMMGNELTFPEDSICTGTSSGNQVNLTIQGLRAMDTGLYICKVEQMYPPPYLRGIGKGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 358 - protein, 364 aa, Artificial Sequence
  A19V/G29W/R35K/L63P/L98Q/M99L/Y105L CTLA4-Fc
KAMHVAQPAVVLASSRGIVSFVCEYASPWKATEVKVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 359 - protein, 364 aa, Artificial Sequence
  L12P/A26T/L63P/S72G/T89M/L98Q/M99L/Y105L-Fc
KAMHVAQPAVVPASSRGIASFVCEYTSPGKATEVRVTVLRQADSQVTEVCAATYMMGNELTFPDDSICTGTGSGNQVNLTIQGLRAMDMGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 360 - protein, 364 aa, Artificial Sequence
  P28L/E33V/L63P/S72G/L98R/M99L/Y105L-Fc
KAMHVAQPAVVLASSRGIASFVCEYASLGKATVVRVTVLRQADSQVTEVCAATYMMGNELTFPDDSICTGTGSGNQVNLTIQGLRAMDTGLYICKVERLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 361 - protein, 364 aa, Artificial Sequence
  E24Q/L63P/S72G/L98Q/M99L/Y105L-Fc
KAMHVAQPAVVLASSRGIASFVCQYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 364 aa, Artificial Sequence
  I18T/G29R/L63P/S72G/L98Q/M99L/Y105L-Fc
KAMHVAQPAVVLASSRGTASFVCEYASPRKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - protein, 364 aa, Artificial Sequence
  L63P/L98Q/M99L/Y105L-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 364 - protein, 364 aa, Artificial Sequence
  Q41L/Y54F/M56K/M99L/I108F-Fc
KAMHVAQPAVVLASSRGIASFVCEYASPGKATEVRVTVLRLADSQVTEVCAATFMKGNELTFLDDSICTGTSSGNQVNLTIQGLRAMDTGLYICKVELLYPPPYYLGFGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 365 - protein, 364 aa, Artificial Sequence
  S72G/L98Q/M99L/Y105L/I117T-Fc
KAMHVAQPAVVLASSRGIASFVCEYASPGKATEVRVTVLRQADSQVTEVCAATYMMGNELTFLDDSICTGTGSGNQVNLTIQGLRAMDTGLYICKVEQLYPPPYLLGIGNGTQIYVTDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 366 - protein, 364 aa, Artificial Sequence
  M56R/L63P/L98Q/M99L/Y105L-Fc
KAMHVAQPAVVLASSRGIASFVCEYASPGKATEVRVTVLRQADSQVTEVCAATYMRGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 367 - protein, 364 aa, Artificial Sequence
  E33M/L63P/S72G/L98Q/Y105L-Fc
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 368 - protein, 364 aa, Artificial Sequence
  L63P/L98Q/M99L/Y105L/L106I-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 369 - protein, 364 aa, Artificial Sequence
  A26T/M55R/L98Q/M99L/Y105L-Fc
KAMHVAQPAVVLASSRGIASFVCEYTSPGKATEVRVTVLRQADSQVTEVCAATYRMGNELTFLDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 370 - protein, 364 aa, Artificial Sequence
  L63P/S72G/M87A/L98Q/Y105L-Fc
KAMHVAQPAVVLASSRGIASFVCEYASPGKATEVRVTVLRQADSQVTEVCAATYMMGNELTFPDDSICTGTGSGNQVNLTIQGLRAADTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 371 - protein, 364 aa, Artificial Sequence
  A26D/S72G/L98Q/M99L/Y105L-Fc
KAMHVAQPAVVLASSRGIASFVCEYDSPGKATEVRVTVLRQADSQVTEVCAATYMMGNELTFLDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 372 - protein, 364 aa, Artificial Sequence
  V22A/L63P/L98Q/M99L/Y105L/P119H-Fc
KAMHVAQPAVVLASSRGIASFACEYASPGKATEVRVTVLRQADSQVTEVCAATYMMGNELTFPDDSICTGTSSGNQVNLTIQGLRAMDTGLYICKVEQLYPPPYLLGIGNGTQIYVIDHEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 373 - protein, 364 aa, Artificial Sequence
  A26T/M55T/L63P/L98Q/M99L/Y105L-Fc
KAMHVAQPAVVLASSRGIASFVCEYTSPGKATEVRVTVLRQADSQVTEVCAATYTMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 374 - protein, 364 aa, Artificial Sequence
  E33V/A42S/M55T/L98Q/M99L/Y105L-Fc
KAMHVAQPAVVLASSRGIASFVCEYASPGKATVVRVTVLRQSDSQVTEVCAATYTMGNELTFLDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 375 - protein, 364 aa, Artificial Sequence
  G29W/N58S/L63P/Q82R/L98Q/Y105L-Fc
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 376 - protein, 364 aa, Artificial Sequence
  E33M/L63P/S72G/L98Q/Y105L/I117L-Fc
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 377 - protein, 364 aa, Artificial Sequence
  A26T/I67N/S72G/L98Q/M99L/Y105L-Fc
KAMHVAQPAVVLASSRGIASFVCEYTSPGKATEVRVTVLRQADSQVTEVCAATYMMGNELTFLDDSNCTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 378 - protein, 364 aa, Artificial Sequence
  L12F/A26T/L63P/L98Q/Y105L/L106R-Fc
KAMHVAQPAVVFASSRGIASFVCEYTSPGKATEVRVTVLRQADSQVTEVCAATYMMGNELTFPDDSICTGTSSGNQVNLTIQGLRAMDTGLYICKVEQMYPPPYLRGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 379 - protein, 364 aa, Artificial Sequence
  S20N/A26T/L63P/L98Q/M99L/Y105L-Fc
KAMHVAQPAVVLASSRGIANFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 380 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 381 - protein, 364 aa, Artificial Sequence
  G29W/T61I/L63P/S72G/L98Q/M99L/Y105L-Fc
KAMHVAQPAVVLASSRGIASFVCEYASPWKATEVRVTVLRQADSQVTEVCAATYMMGNELIFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 382 - protein, 364 aa, Artificial Sequence
  G29W/N58S/L63P/T69I/L98Q/M99L/Y105L-Fc
KAMHVAQPAVVLASSRGIASFVCEYASPWKATEVRVTVLRQADSQVTEVCAATYMMGSELTFPDDSICIGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 383 - protein, 364 aa, Artificial Sequence
  L12P/L63P/S72G/L98Q/M99L/Y105L/L106N-Fc
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 384 - protein, 364 aa, Artificial Sequence
  L63P/T69A/L98Q/M99L/Y105L/L106R/V116A-Fc
KAMHVAQPAVVLASSRGIASFVCEYASPGKATEVRVTVLRQADSQVTEVCAATYMMGNELTFPDDSICAGTSSGNQVNLTIQGLRAMDTGLYICKVEQLYPPPYLRGIGNGTQIYAIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 385 - protein, 364 aa, Artificial Sequence
  G29W/N58S/L63P/S72G/L98Q/Y105L-Fc
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 386 - protein, 364 aa, Artificial Sequence
  G29W/L63P/D65G/S72G/L98Q/Y105L-Fc
KAMHVAQPAVVLASSRGIASFVCEYASPWKATEVRVTVLRQADSQVTEVCAATYMMGNELTFPDGSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 387 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 388 - protein, 364 aa, Artificial Sequence
  T53S/M56V/L98Q/Y105L-Fc
KAMHVAQPAVVLASSRGIASFVCEYASPGKATEVRVTVLRQADSQVTEVCAASYMVGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 389 - protein, 364 aa, Artificial Sequence
  L63P/S72G/L98Q/Y105L-Fc
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 390 - protein, 364 aa, Artificial Sequence
  I18A/L63P/S72G/L98Q/Y105L-Fc
KAMHVAQPAVVLASSRGAASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 391 - protein, 364 aa, Artificial Sequence
  G29W/T53S/M56K/L63P/L98Q/Y105L-Fc
KAMHVAQPAVVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 392 - protein, 364 aa, Artificial Sequence
  I18V/G29W/L63P/S72G/L98Q/Y105L-Fc
KAMHVAQPAVVLASSRGVASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 393 - protein, 364 aa, Artificial Sequence
  G29W/L63P/S72G/L98Q/Y105L/L106I-Fc
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 394 - protein, 364 aa, Artificial Sequence
  G29W/L63P/I67V/S72G/L98Q/Y105L-Fc
KAMHVAQPAVVLASSRGIASFVCEYASPWKATEVRVTVLRQADSQVTEVCAATYMMGNELTFPDDSVCTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 395 - protein, 364 aa, Artificial Sequence
  G29W/M55V/E59G/L63P/L98Q/Y105L-Fc
KAMHVAQPAVVLASSRGIASFVCEYASPWKATEVRVTVLRQADSQVTEVCAATYVMGNGLTFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 396 - protein, 364 aa, Artificial Sequence
  G29W/L63P/S72G/L98Q/Y105L/I117L-Fc
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 397 - protein, 364 aa, Artificial Sequence
  L63P/S72G/L98Q/Y105L/L106I/I117L-Fc
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 398 - protein, 364 aa, Artificial Sequence
  L12F/R16H/G29W/M56T/L98Q/Y105L-Fc
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 399 - protein, 364 aa, Artificial Sequence
  L12P/G29W/L63P/S72G/L98Q/Y105L-Fc
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 400 - protein, 364 aa, Artificial Sequence
  L12P/G29W/L63P/S72G/L98Q/Y105L/L106I-Fc
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 401 - protein, 364 aa, Artificial Sequence
  G29W/L63P/S72G/L98Q/Y105L/L106I/I117L-Fc
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 402 - protein, 364 aa, Artificial Sequence
  G29W/N58S/L63P/S72G/L98Q/Y105L/L106I-Fc
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 403 - protein, 364 aa, Artificial Sequence
  A26T/T53S/L63P/L98Q/Y105L/L106I/I117L-Fc
KAMHVAQPAVVLASSRGIASFVCEYTSPGKATEVRVTVLRQADSQVTEVCAASYMMGNELTFPDDSICTGTSSGNQVNLTIQGLRAMDTGLYICKVEQMYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 404 - protein, 364 aa, Artificial Sequence
  G29W/N58S/L63P/S72G/M87V/L98Q/Y105L-Fc
KAMHVAQPAVVLASSRGIASFVCEYASPWKATEVRVTVLRQADSQVTEVCAATYMMGSELTFPDDSICTGTGSGNQVNLTIQGLRAVDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 405 - protein, 364 aa, Artificial Sequence
  G29W/S72G/Q76R/L98Q/Y105L/L106I/Q113H-Fc
KAMHVAQPAVVLASSRGIASFVCEYASPWKATEVRVTVLRQADSQVTEVCAATYMMGNELTFLDDSICTGTGSGNRVNLTIQGLRAMDTGLYICKVEQMYPPPYLIGIGNGTHIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 406 - protein, 364 aa, Artificial Sequence
  G29W/N58S/L63P/S72G/L98Q/Y105L/L106V-Fc
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLVGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 407 - protein, 364 aa, Artificial Sequence
  A26T/L63P/L98Q/M99L/Y105L-Fc
KAMHVAQPAVVLASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 408 - protein, 364 aa, Artificial Sequence
  G29W/N58D/I67V/L98Q/M99L/Y105L-Fc
KAMHVAQPAVVLASSRGIASFVCEYASPWKATEVRVTVLRQADSQVTEVCAATYMMGDELTFLDDSVCTGTSSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 409 - protein, 364 aa, Artificial Sequence
  I67V/S72G/Q82H/T89A/L98Q/M99L/Y105L-Fc
KAMHVAQPAVVLASSRGIASFVCEYASPGKATEVRVTVLRQADSQVTEVCAATYMMGNELTFLDDSVCTGTGSGNQVNLTIHGLRAMDAGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 410 - protein, 364 aa, Artificial Sequence
  S72G/R85G/L98Q/M99L/Y105L/L106I-Fc
KAMHVAQPAVVLASSRGIASFVCEYASPGKATEVRVTVLRQADSQVTEVCAATYMMGNELTFLDDSICTGTGSGNQVNLTIQGLGAMDTGLYICKVEQLYPPPYLIGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 411 - protein, 364 aa, Artificial Sequence
  A26T/T47A/M56K/L63P/S72G/Q82R/L98Q/M99L/Y105L-Fc
KAMHVAQPAVVLASSRGIASFVCEYTSPGKATEVRVTVLRQADSQVAEVCAATYMKGNELTFPDDSICTGTGSGNQVNLTIRGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 412 - protein, 364 aa, Artificial Sequence
  A26T/M55T/L63P/S72G/L98Q/M99L/Y105L-Fc
KAMHVAQPAVVLASSRGIASFVCEYTSPGKATEVRVTVLRQADSQVTEVCAATYTMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 413 - protein, 364 aa, Artificial Sequence
  L12H/I18V/A42T/M55T/N58D/L98R/Y105L/L106I/P121S-Fc
KAMHVAQPAVVHASSRGVASFVCEYASPGKATEVRVTVLRQTDSQVTEVCAATYTMGDELTFLDDSICTGTSSGNQVNLTIQGLRAMDTGLYICKVERMYPPPYLIGIGNGTQIYVIDPESCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 414 - protein, 364 aa, Artificial Sequence
  I18T/A26T/L63P/S72G/L98Q/Y105L-Fc
KAMHVAQPAVVLASSRGTASFVCEYTSPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 415 - protein, 364 aa, Artificial Sequence
  L12F/K30R/S72G/Q82R/L98Q/M99L/Y105L-Fc
KAMHVAQPAVVFASSRGIASFVCEYASPGRATEVRVTVLRQADSQVTEVCAATYMMGNELTFLDDSICTGTGSGNQVNLTIRGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 416 - protein, 364 aa, Artificial Sequence
  L12P/L63P/S72G/L98Q/M99L/Y105L/L106N/I117L-Fc
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 417 - protein, 364 aa, Artificial Sequence
  G29W/M87K/I93V/L98Q/M99L/Y105L-Fc
KAMHVAQPAVVLASSRGIASFVCEYASPWKATEVRVTVLRQADSQVTEVCAATYMMGNELTFLDDSICTGTSSGNQVNLTIQGLRAKDTGLYVCKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 418 - protein, 364 aa, Artificial Sequence
  P28L/E33V/L63P/S72G/L98Q/M99L/Y105L-Fc
KAMHVAQPAVVLASSRGIASFVCEYASLGKATVVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 419 - protein, 364 aa, Artificial Sequence
  G29W/T53S/M56K/L63P/Q82H/L98Q/M99I/Y105L-Fc
KAMHVAQPAVVLASSRGIASFVCEYASPWKATEVRVTVLRQADSQVTEVCAASYMKGNELTFPDDSICTGTSSGNQVNLTIHGLRAMDTGLYICKVEQIYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 420 - protein, 364 aa, Artificial Sequence
  I18F/L63P/L98Q/M99L/Y105L/P121S-Fc
KAMHVAQPAVVLASSRGFASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPESCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 421 - protein, 364 aa, Artificial Sequence
  L63P/L98Q/M99L/Y105L/I108V-Fc
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGVGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 422 - protein, 364 aa, Artificial Sequence
  A26T/A42V/Q45H/I67N/M87K/E97Q/M99L-Fc
KAMHVAQPAVVLASSRGIASFVCEYTSPGKATEVRVTVLRQVDSHVTEVCAATYMMGNELTFLDDSNCTGTSSGNQVNLTIQGLRAKDTGLYICKVQLLYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 423 - protein, 364 aa, Artificial Sequence
  M56V/E59G/L63P/S72G/M87K/I93V/L98Q/M99L/Y105L/I117E-Fc
KAMHVAQPAVVLASSRGIASFVCEYASPGKATEVRVTVLRQADSQVTEVCAATYMVGNGLTFPDDSICTGTGSGNQVNLTIQGLRAKDTGLYVCKVEQLYPPPYLLGIGNGTQIYVEDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 424 - protein, 364 aa, Artificial Sequence
  G29W/M87K/T89S/L98Q/M99L/Y105L/I108V/I117L-Fc
KAMHVAQPAVVLASSRGIASFVCEYASPWKATEVRVTVLRQADSQVTEVCAATYMMGNELTFLDDSICTGTSSGNQVNLTIQGLRAKDSGLYICKVEQLYPPPYLLGVGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 425 - protein, 364 aa, Artificial Sequence
  L12P/M56V/L63P/V96I/L98Q/M99L/Y105L/Y115H-Fc
KAMHVAQPAVVPASSRGIASFVCEYASPGKATEVRVTVLRQADSQVTEVCAATYMVGNELTFPDDSICTGTSSGNQVNLTIQGLRAMDTGLYICKIEQLYPPPYLLGIGNGTQIHVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 426 - protein, 364 aa, Artificial Sequence
  G29W/T53S/M56K/T61N/L63P/L98Q/Y105L-Fc
KAMHVAQPAVVLASSRGIASFVCEYASPWKATEVRVTVLRQADSQVTEVCAASYMKGNELNFPDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 427 - protein, 364 aa, Artificial Sequence
  I18T/A26S/M55T/M56V/L63P/S72G/L98Q/M99L/Y105L/I117K-Fc
KAMHVAQPAVVLASSRGTASFVCEYSSPGKATEVRVTVLRQADSQVTEVCAATYTVGNELTFPDDSICTGTGSGNQVNLTIQGLRAMDTGLYICKVEQLYPPPYLLGIGNGTQIYVKDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 428 - protein, 364 aa, Artificial Sequence
  I18T/T61R/L63P/S72G/L98Q/M99L/Y105L-Fc
KAMHVAQPAVVLASSRGTASFVCEYASPGKATEVRVTVLRQADSQVTEVCAATYMMGNELRFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 429 - protein, 364 aa, Artificial Sequence
  L12P/L63P/S72G/L98Q/M99L/Y105L-Fc
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 430 - protein, 364 aa, Artificial Sequence
  E33M/L63P/S72G/L98Q/Y105L/I108F-Fc
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGFGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 431 - protein, 364 aa, Artificial Sequence
  L12P/R16H/A26T/T61S/L63P/M87V/L98Q/M99L/Y105L/L106I/I117L-Fc
KAMHVAQPAVVPASSHGIASFVCEYTSPGKATEVRVTVLRQADSQVTEVCAATYMMGNELSFPDDSICTGTSSGNQVNLTIQGLRAVDTGLYICKVEQLYPPPYLIGIGNGTQIYVLDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 432 - protein, 364 aa, Artificial Sequence
  G29W/T53S/M56K/N58S/L63P/M87V/L98Q/Y105L/P121S-Fc
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPESCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 433 - protein, 364 aa, Artificial Sequence
  G29W/L63P/S72G/L98Q/Y105L/P121S-Fc
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPESCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 434 - protein, 364 aa, Artificial Sequence
  G29W/T53S/M56K/N58S/L63P/M87V/L98Q/Y105L-Fc
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 435 - protein, 364 aa, Artificial Sequence
  G29W/T53S/M56K/N58S/L63P/M87V/L98Q/Y105L/I108V-Fc
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGVGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 436 - protein, 364 aa, Artificial Sequence
  G29W/T53S/L63P/S72G/L98Q/Y105L-Fc
KAMHVAQPAVVLASSRGIASFVCEYASPWKATEVRVTVLRQADSQVTEVCAASYMMGNELTFPDDSICTGTGSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 437 - protein, 364 aa, Artificial Sequence
  V10A/G29W/T53S/M56K/L63P/L98Q/Y105L/P121S-Fc
KAMHVAQPAAVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPESCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 438 - protein, 231 aa, Artificial Sequence
  Fc deltaK (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 439 - protein, 232 aa, Artificial Sequence
  Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 232 aa, Artificial Sequence
  Fc (C220S/R292C/N297G/V302C)
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - protein, 232 aa, Artificial Sequence
  Fc (C220S/L234A/L235E/G237A)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 231 aa, Artificial Sequence
  Fc (C220S/E233P/L234V/L235A/G236del/S267K)
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 444 - protein, 329 aa, Homo sapiens
  MISC_FEATURE: CD86 (B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 445 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 446 - protein, 273 aa, Homo sapiens
  MISC_FEATURE: PDCD1LG2 (PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 447 - protein, 302 aa, Homo sapiens
  MISC_FEATURE: ICOSLG (B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 448 - protein, 534 aa, Homo sapiens
  MISC_FEATURE: CD276 (B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 449 - protein, 282 aa, Homo sapiens
  MISC_FEATURE: VTCN1 (B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 450 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 451 - protein, 288 aa, Homo sapiens
  MISC_FEATURE: PDCD1 (PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 452 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 453 - protein, 289 aa, Homo sapiens
  MISC_FEATURE: BTLA (CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 454 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 455 - protein, 235 aa, Homo sapiens
  MISC_FEATURE: CD8A (CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 456 - protein, 210 aa, Homo sapiens
  MISC_FEATURE: CD8B (CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 457 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 458 - protein, 301 aa, Homo sapiens
  MISC_FEATURE: HAVCR2 (TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 459 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 460 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 461 - protein, 417 aa, Homo sapiens
  MISC_FEATURE: PVR (CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 462 - protein, 538 aa, Homo sapiens
  MISC_FEATURE: PVRL2 (CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 463 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 464 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 465 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 466 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 467 - protein, 325 aa, Homo sapiens [sequence omitted]

SEQ ID NO: 468 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 469 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 470 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 471 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 472 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 473 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 474 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 475 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 476 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 477 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 478 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 479 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 480 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 481 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 482 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 483 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 484 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 485 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 486 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 487 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 488 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 489 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 490 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 491 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 492 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 493 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 494 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 495 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 496 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 497 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 498 - protein, 208 aa, Homo sapiens [sequence omitted]

SEQ ID NO: 499 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 500 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 501 - protein, 201 aa, Homo sapiens
  MISC_FEATURE: PDCD1LG2 (PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 502 - protein, 238 aa, Homo sapiens [sequence omitted]

SEQ ID NO: 503 - protein, 438 aa, Homo sapiens
  MISC_FEATURE: CD276 (B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 504 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 505 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 506 - protein, 150 aa, Homo sapiens [sequence omitted]

SEQ ID NO: 507 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 508 - protein, 127 aa, Homo sapiens
  MISC_FEATURE: BTLA (CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 509 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 510 - protein, 161 aa, Homo sapiens
  MISC_FEATURE: CD8A (CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 511 - protein, 149 aa, Homo sapiens
  MISC_FEATURE: CD8B (CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 512 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 513 - protein, 181 aa, Homo Sapiens
  MISC_FEATURE: HAVCR2 (TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 514 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 515 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 516 - protein, 323 aa, Homo sapiens
  MISC_FEATURE: PVR (CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 517 - protein, 329 aa, Homo sapiens
  MISC_FEATURE: PVRL2 (CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 518 - protein, 236 aa, Homo sapiens [sequence omitted]

SEQ ID NO: 519 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 520 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 521 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 522 - protein, 215 aa, Homo sapiens
  MISC_FEATURE: CD200R1 (CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 523 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 524 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 525 - protein, 231 aa, Artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 526 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 527 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 528 - protein, 230 aa, Artificial Sequence; identical to SEQ ID NO: 527
  Fc with C220S/E233P/L234V/L235A/G236del/S267K/K447del

SEQ ID NO: 529 - protein, 235 aa, Artificial Sequence
  IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 530 - protein, 229 aa, Artificial Sequences
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 531 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 532 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 232 aa, Homo sapiens
  MISC_FEATURE: IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 534 - protein, 7 aa, Artificial Sequence
  Linker
GSGGGGS

SEQ ID NO: 535 - protein, 5 aa, Artificial Sequence
  4GS Linker
GGGGS

SEQ ID NO: 536 - protein, 15 aa, Artificial Sequence
  IgV-IgV linker
GGGGSGGGGSGGGGS

SEQ ID NO: 537 - protein, 10 aa, Artificial Sequence
  IgV-Fc linker 1
GGGGSGGGGS

SEQ ID NO: 538 - protein, 13 aa, Artificial Sequence
  IgV-Fc linker 2
GGGGSGGGGSAAA

SEQ ID NO: 539 - protein, 8 aa, Artificial Sequence
  Stuffer
HMSSVSAQ

SEQ ID NO: 540 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 541 - protein, 69 aa, Artificial Sequence
  CD8-derived hinge and transmembrane domain (2nd gen CAR)
AKPTTTPAPRPPTPAPTIASQPLSLRPEACRPAAGGAVHTRGLDFACDIYIWAPLAGTCGVLLLSLVIT

SEQ ID NO: 542 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 543 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 544 - protein, 40 aa, Artificial Sequence
  CD28-derived costimulatory domain
SKRSRLLHSDYMNMTPRRPGPTRKHYQPYAPPRDFAAYRS

SEQ ID NO: 545 - protein, 41 aa, Artificial Sequence
  CD28-derived costimulatory domain 2
RSKRSRLLHSDYMNMTPRRPGPTRKHYQPYAPPRDFAAYRS

SEQ ID NO: 546 - protein, 44 aa, Artificial Sequence
  CD28-derived costimulatory domain 3
FWVRSKRSRLLHSDYMNMTPRRPGPTRKHYQPYAPPRDFAAYRS

SEQ ID NO: 547 - protein, 18 aa, Artificial Sequence
  HSA signal peptide
MKWVTFISLLFLFSSAYS

SEQ ID NO: 548 - protein, 22 aa, Artificial Sequence
  Ig kappa light chain
MDMRAPAGIFGFLLVLFPGYRS

SEQ ID NO: 549 - protein, 19 aa, Artificial Sequence
  Human azurocidin preprotein signal sequence
MTRLTVLALLAGLLASSRA

SEQ ID NO: 550 - protein, 19 aa, Artificial Sequence
  IgG heavy chain signal peptide
MELGLSWIFLLAILKGVQC

SEQ ID NO: 551 - protein, 19 aa, Artificial Sequence
  IgG heavy chain signal peptide
MELGLRWVFLVAILEGVQC

SEQ ID NO: 552 - protein, 19 aa, Artificial Sequence
  IgG heavy chain signal peptide
MKHLWFFLLLVAAPRWVLS

SEQ ID NO: 553 - protein, 19 aa, Artificial Sequence
  IgG heavy chain signal peptide
MDWTWRILFLVAAATGAHS

SEQ ID NO: 554 - protein, 19 aa, Artificial Sequence
  IgG heavy chain signal peptide
MDWTWRFLFVVAAATGVQS

SEQ ID NO: 555 - protein, 19 aa, Artificial Sequence
  IgG heavy chain signal peptide
MEFGLSWLFLVAILKGVQC

SEQ ID NO: 556 - protein, 19 aa, Artificial Sequence
  IgG heavy chain signal peptide
MEFGLSWVFLVALFRGVQC

SEQ ID NO: 557 - protein, 26 aa, Artificial Sequence
  IgG heavy chain signal peptide
MDLLHKNMKHLWFFLLLVAAPRWVLS

SEQ ID NO: 558 - protein, 22 aa, Artificial Sequence
  IgG Kappa light chain signal sequence
MDMRVPAQLLGLLLLWLSGARC

SEQ ID NO: 559 - protein, 22 aa, Artificial Sequence
  IgG Kappa light chain signal sequence
MKYLLPTAAAGLLLLAAQPAMA

SEQ ID NO: 560 - protein, 17 aa, Artificial Sequence
  Gaussia luciferase
MGVKVLFALICIAVAEA

SEQ ID NO: 561 - protein, 18 aa, Artificial Sequence
  Human albumin
MKWVTFISLLFLFSSAYS

SEQ ID NO: 562 - protein, 18 aa, Artificial Sequence
  Human chymotrypsinogen
MAFLWLLSCWALLGTTFG

SEQ ID NO: 563 - protein, 14 aa, Artificial Sequence
  Human interleukin-2
MQLLSCIALILALV

SEQ ID NO: 564 - protein, 15 aa, Artificial Sequence
  Human trypsinogen-2
MNLLLILTFVAAAVA

SEQ ID NO: 565 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 566 - protein, 20 aa, Artificial Sequence
  T2A protein
SGEGRGSLLTCGDVEENPGP

SEQ ID NO: 567 - protein, 21 aa, Artificial Sequence
  T2A Protein
GSGEGRGSLLTCGDVEENPGP

SEQ ID NO: 568 - protein, 18 aa, Artificial Sequence
  T2A
EGRGSLLTCGDVEENPGP

SEQ ID NO: 569 - protein, 127 aa, Artificial Sequence
  CTLA-4 wild-type ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQ

SEQ ID NO: 570 - protein, 126 aa, Artificial sequence
  T89A/L98Q/M99L/Y105L/L106I/Y115N/E120D/C122P/D124P/S125I/D126P ECD
KAMHVAQPAVVLASSRGIASFVCEYASPGKATEVRVTVLRQADSQVTEVCAATYMMGNELTFLDDSICTGTSSGNQVNLTIQGLRAMDAGLYICKVEQLYPPPYLIGIGNGTQINVIDPDPPPPIP

SEQ ID NO: 571 - protein, 126 aa, Artificial sequence
  N58S/L63P/T71A/S72G/L98Q/M99L/Y105L/D124I/S125P/D126T ECD
KAMHVAQPAVVLASSRGIASFVCEYASPGKATEVRVTVLRQADSQVTEVCAATYMMGSELTFPDDSICTGAGSGNQVNLTIQGLRAMDTGLYICKVEQLYPPPYLLGIGNGTQIYVIDPEPCPIPT

SEQ ID NO: 572 - protein, 126 aa, Artificial sequence
  R16G/E33M/N58S/E59G/L63P/L98Q/Y105L/E120D/C122P/D124P/S125I/D126P ECD
KAMHVAQPAVVLASSGGIASFVCEYASPGKATMVRVTVLRQADSQVTEVCAATYMMGSGLTFPDDSICTGTSSGNQVNLTIQGLRAMDTGLYICKVEQMYPPPYLLGIGNGTQIYVIDPDPPPPIP

SEQ ID NO: 573 - protein, 126 aa, Artificial sequence
  G29W/L63P/S72G/L98Q/Y105L/P121S/D126T ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPESCPDST

SEQ ID NO: 574 - protein, 126 aa, Artificial sequence
  L12H/E33M/L98Q/Y105L ECD
KAMHVAQPAVVHASSRGIASFVCEYASPGKATMVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 575 - protein, 126 aa, Artificial sequence
  T53S/M56K/N58S/L63P/M87V/L98Q/Y105L ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYLLGIGNGTQIYVIDPEPCPDSD

SEQ ID NO: 576 - protein, 126 aa, Artificial sequence
  I18T/A26T/M55T/M56K/L63P/L98Q/M99L/Y105L ECD
KAMHVAQPAVVLASSRGTASFVCEYTSPGKATEVRVTVLRQADSQVTEVCAATYTKGNELTFPDDSICTGTSSGNQVNLTIQGLRAMDTGLYICKVEQLYPPPYLLGIGNGTQIYVIDPEPCPDSD

SEQ ID NO: 577 - protein, 126 aa, Artificial sequence
  I18T/A26T/M56K/L63P/L98Q/Y105L ECD
KAMHVAQPAVVLASSRGTASFVCEYTSPGKATEVRVTVLRQADSQVTEVCAATYMKGNELTFPDDSICTGTSSGNQVNLTIQGLRAMDTGLYICKVEQMYPPPYLLGIGNGTQIYVIDPEPCPDSD

SEQ ID NO: 578 - protein, 126 aa, Artificial sequence
  T53S/L63P/L98Q ECD
KAMHVAQPAVVLASSRGIASFVCEYASPGKATEVRVTVLRQADSQVTEVCAASYMMGNELTFPDDSICTGTSSGNQVNLTIQGLRAMDTGLYICKVEQMYPPPYYLGIGNGTQIYVIDPEPCPDSD

SEQ ID NO: 579 - protein, 126 aa, Artificial sequence
  T53S/L63P/Y105L ECD
KAMHVAQPAVVLASSRGIASFVCEYASPGKATEVRVTVLRQADSQVTEVCAASYMMGNELTFPDDSICTGTSSGNQVNLTIQGLRAMDTGLYICKVELMYPPPYLLGIGNGTQIYVIDPEPCPDSD

SEQ ID NO: 580 - protein, 126 aa, Artificial sequence
  T53S/M56K/N58S/L63P/M87V/L98Q ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYYLGIGNGTQIYVIDPEPCPDSD

SEQ ID NO: 581 - protein, 126 aa, Artificial sequence
  T53S/M56K/N58S/L63P/M87V/Y105L ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVELMYPPPYLLGIGNGTQIYVIDPEPCPDSD

SEQ ID NO: 582 - protein, 126 aa, Artificial sequence
  T53S/M56K/N58S/L63P/L98Q/Y105L ECD
KAMHVAQPAVVLASSRGIASFVCEYASPGKATEVRVTVLRQADSQVTEVCAASYMKGSELTFPDDSICTGTSSGNQVNLTIQGLRAMDTGLYICKVEQMYPPPYLLGIGNGTQIYVIDPEPCPDSD

SEQ ID NO: 583 - protein, 126 aa, Artificial sequence
  T53S/M56K/N58S/M87V/L98Q/Y105L ECD
KAMHVAQPAVVLASSRGIASFVCEYASPGKATEVRVTVLRQADSQVTEVCAASYMKGSELTFLDDSICTGTSSGNQVNLTIQGLRAVDTGLYICKVEQMYPPPYLLGIGNGTQIYVIDPEPCPDSD

SEQ ID NO: 584 - protein, 126 aa, Artificial sequence
  T53S/M56K/L63P/M87V/L98Q/Y105L ECD
KAMHVAQPAVVLASSRGIASFVCEYASPGKATEVRVTVLRQADSQVTEVCAASYMKGNELTFPDDSICTGTSSGNQVNLTIQGLRAVDTGLYICKVEQMYPPPYLLGIGNGTQIYVIDPEPCPDSD

SEQ ID NO: 585 - protein, 126 aa, Artificial sequence
  T53S/N58S/L63P/M87V/L98Q/Y105L ECD
KAMHVAQPAVVLASSRGIASFVCEYASPGKATEVRVTVLRQADSQVTEVCAASYMMGSELTFPDDSICTGTSSGNQVNLTIQGLRAVDTGLYICKVEQMYPPPYLLGIGNGTQIYVIDPEPCPDSD

SEQ ID NO: 586 - protein, 126 aa, Artificial sequence
  M56K/N58S/L63P/M87V/L98Q/Y105L ECD
KAMHVAQPAVVLASSRGIASFVCEYASPGKATEVRVTVLRQADSQVTEVCAATYMKGSELTFPDDSICTGTSSGNQVNLTIQGLRAVDTGLYICKVEQMYPPPYLLGIGNGTQIYVIDPEPCPDSD

SEQ ID NO: 587 - protein, 126 aa, Artificial sequence
  E33V/L98Q/Y105L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 588 - protein, 126 aa, Artificial sequence
  E33V/M99L/Y105L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYLLGIGNGTQIYVIDPEPCPDSD

SEQ ID NO: 589 - protein, 126 aa, Artificial sequence
  E33V/L98Q/M99L  ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVEQLYPPPYYLGIGNGTQIYVIDPEPCPDSD

SEQ ID NO: 590 - protein, 126 aa, Artificial sequence
  E33V/M99L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYYLGIGNGTQIYVIDPEPCPDSD

SEQ ID NO: 591 - protein, 126 aa, Artificial sequence
  L12F/R16H/G29W/M56T/L98Q ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYYLGIGNGTQIYVIDPEPCPDSD

SEQ ID NO: 592 - protein, 126 aa, Artificial sequence
  L12F/R16H/G29W/M56T/Y105L ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVELMYPPPYLLGIGNGTQIYVIDPEPCPDSD

SEQ ID NO: 593 - protein, 126 aa, Artificial sequence
  L12F/R16H/G29W/L98Q/Y105L ECD
KAMHVAQPAVVFASSHGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 594 - protein, 126 aa, Artificial sequence
  L12F/R16H/M56T/L98Q/Y105L ECD
KAMHVAQPAVVFASSHGIASFVCEYASPGKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 595 - protein, 126 aa, Artificial sequence
  G29W/M56T/L98Q/Y105L ECD
KAMHVAQPAVVLASSRGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 596 - protein, 126 aa, Artificial sequence
  L12F/G29W/L98Q/Y105L ECD
KAMHVAQPAVVFASSRGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 597 - protein, 126 aa, Artificial sequence
  L12F/L98Q/Y105L ECD
KAMHVAQPAVVFASSRGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 598 - protein, 126 aa, Artificial sequence
  R16H/L98Q/Y105L ECD
KAMHVAQPAVVLASSHGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 599 - protein, 126 aa, Artificial sequence
  G29W/L98Q/Y105L ECD
KAMHVAQPAVVLASSRGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 600 - protein, 126 aa, Artificial sequence
  M56T/L98Q/Y105L ECD
KAMHVAQPAVVLASSRGIASFVCEYASPGKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 601 - protein, 126 aa, Artificial sequence
  L12F/R16H/G29W/M56T/S72G/L98Q/Y105L ECD
KAMHVAQPAVVFASSHGIASFVCEYASPWKATEVRVTVLRQADSQVTEVCAATYMTGNELTFLDDSICTGTGSGNQVNLTIQGLRAMDTGLYICKVEQMYPPPYLLGIGNGTQIYVIDPEPCPDSD

SEQ ID NO: 602 - protein, 126 aa, Artificial sequence
  G29W/M56T/S72G/L98Q/Y105L ECD
KAMHVAQPAVVLASSRGIASFVCEYASPWKATEVRVTVLRQADSQVTEVCAATYMTGNELTFLDDSICTGTGSGNQVNLTIQGLRAMDTGLYICKVEQMYPPPYLLGIGNGTQIYVIDPEPCPDSD

SEQ ID NO: 603 - protein, 102 aa, Artificial sequence
  T89A/L98Q/M99L/Y105L/L106I/Y115N/E120D/C122P/D124P/S125I/D126P IgV domain
HVAQPAVVLASSRGIASFVCEYASPGKATEVRVTVLRQADSQVTEVCAATYMMGNELTFLDDSICTGTSSGNQVNLTIQGLRAMDAGLYICKVEQLYPPPYL

SEQ ID NO: 604 - protein, 102 aa, Artificial sequence
  N58S/L63P/T71A/S72G/L98Q/M99L/Y105L/D124I/S125P/D126T IgV domain
HVAQPAVVLASSRGIASFVCEYASPGKATEVRVTVLRQADSQVTEVCAATYMMGSELTFPDDSICTGAGSGNQVNLTIQGLRAMDTGLYICKVEQLYPPPYL

SEQ ID NO: 605 - protein, 102 aa, Artificial sequence
  R16G/E33M/N58S/E59G/L63P/L98Q/Y105L/E120D/C122P/D124P/S125I/D126P IgV
HVAQPAVVLASSGGIASFVCEYASPGKATMVRVTVLRQADSQVTEVCAATYMMGSGLTFPDDSICTGTSSGNQVNLTIQGLRAMDTGLYICKVEQMYPPPYL

SEQ ID NO: 606 - protein, 102 aa, Artificial sequence; identical to SEQ ID NO: 254
  G29W/L63P/S72G/L98Q/Y105L/P121S/D126T IgV domain

SEQ ID NO: 607 - protein, 102 aa, Artificial sequence
  L12H/E33M/L98Q/Y105L IgV domain
HVAQPAVVHASSRGIASFVCEYASPGKATMVRVTVLRQADSQVTEVCAATYMMGNELTFLDDSICTGTSSGNQVNLTIQGLRAMDTGLYICKVEQMYPPPYL

SEQ ID NO: 608 - protein, 102 aa, Artificial sequence
  T53S/M56K/N58S/L63P/M87V/L98Q/Y105L IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYL

SEQ ID NO: 609 - protein, 102 aa, Artificial sequence
  I18T/A26T/M55T/M56K/L63P/L98Q/ M99L/Y105L IgV domain
HVAQPAVVLASSRGTASFVCEYTSPGKATEVRVTVLRQADSQVTEVCAATYTKGNELTFPDDSICTGTSSGNQVNLTIQGLRAMDTGLYICKVEQLYPPPYL

SEQ ID NO: 610 - protein, 102 aa, Artificial sequence
  I18T/A26T/M56K/L63P/L98Q/Y105L IgV domain
HVAQPAVVLASSRGTASFVCEYTSPGKATEVRVTVLRQADSQVTEVCAATYMKGNELTFPDDSICTGTSSGNQVNLTIQGLRAMDTGLYICKVEQMYPPPYL

SEQ ID NO: 611 - protein, 102 aa, Artificial sequence
  T53S/L63P/L98Q IgV domain
HVAQPAVVLASSRGIASFVCEYASPGKATEVRVTVLRQADSQVTEVCAASYMMGNELTFPDDSICTGTSSGNQVNLTIQGLRAMDTGLYICKVEQMYPPPYY

SEQ ID NO: 612 - protein, 102 aa, Artificial sequence
  T53S/L63P/Y105L IgV domain
HVAQPAVVLASSRGIASFVCEYASPGKATEVRVTVLRQADSQVTEVCAASYMMGNELTFPDDSICTGTSSGNQVNLTIQGLRAMDTGLYICKVELMYPPPYL

SEQ ID NO: 613 - protein, 102 aa, Artificial sequence
  T53S/M56K/N58S/L63P/M87V/L98Q IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYY

SEQ ID NO: 614 - protein, 102 aa, Artificial sequence
  T53S/M56K/N58S/L63P/M87V/Y105L IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVELMYPPPYL

SEQ ID NO: 615 - protein, 102 aa, Artificial sequence
  T53S/M56K/N58S/L63P/L98Q/Y105L IgV domain
HVAQPAVVLASSRGIASFVCEYASPGKATEVRVTVLRQADSQVTEVCAASYMKGSELTFPDDSICTGTSSGNQVNLTIQGLRAMDTGLYICKVEQMYPPPYL

SEQ ID NO: 616 - protein, 102 aa, Artificial sequence
  T53S/M56K/N58S/M87V/L98Q/Y105L IgV domain
HVAQPAVVLASSRGIASFVCEYASPGKATEVRVTVLRQADSQVTEVCAASYMKGSELTFLDDSICTGTSSGNQVNLTIQGLRAVDTGLYICKVEQMYPPPYL

SEQ ID NO: 617 - protein, 102 aa, Artificial sequence
  T53S/M56K/L63P/M87V/L98Q/Y105L IgV domain
HVAQPAVVLASSRGIASFVCEYASPGKATEVRVTVLRQADSQVTEVCAASYMKGNELTFPDDSICTGTSSGNQVNLTIQGLRAVDTGLYICKVEQMYPPPYL

SEQ ID NO: 618 - protein, 102 aa, Artificial sequence
  T53S/N58S/L63P/M87V/L98Q/Y105L IgV domain
HVAQPAVVLASSRGIASFVCEYASPGKATEVRVTVLRQADSQVTEVCAASYMMGSELTFPDDSICTGTSSGNQVNLTIQGLRAVDTGLYICKVEQMYPPPYL

SEQ ID NO: 619 - protein, 102 aa, Artificial sequence
  M56K/N58S/L63P/M87V/L98Q/Y105L IgV domain
HVAQPAVVLASSRGIASFVCEYASPGKATEVRVTVLRQADSQVTEVCAATYMKGSELTFPDDSICTGTSSGNQVNLTIQGLRAVDTGLYICKVEQMYPPPYL

SEQ ID NO: 620 - protein, 102 aa, Artificial sequence
  E33V/L98Q/Y105L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVEQMYPPPYL

SEQ ID NO: 621 - protein, 102 aa, Artificial sequence
  E33V/M99L/Y105L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYL

SEQ ID NO: 622 - protein, 102 aa, Artificial sequence
  E33V/L98Q/M99L  IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVEQLYPPPYY

SEQ ID NO: 623 - protein, 102 aa, Artificial sequence
  E33V/M99L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYY

SEQ ID NO: 624 - protein, 102 aa, Artificial sequence
  L12F/R16H/G29W/M56T/L98Q IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYY

SEQ ID NO: 625 - protein, 102 aa, Artificial sequence
  L12F/R16H/G29W/M56T/Y105L IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVELMYPPPYL

SEQ ID NO: 626 - protein, 102 aa, Artificial sequence
  L12F/R16H/G29W/L98Q/Y105L IgV domain
HVAQPAVVFASSHGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 627 - protein, 102 aa, Artificial sequence
  L12F/R16H/M56T/L98Q/Y105L IgV domain
HVAQPAVVFASSHGIASFVCEYASPGKATEVRVTVLRQADSQVTEVCAATYMTGNELTFLDDSICTGTSSGNQVNLTIQGLRAMDTGLYICKVEQMYPPPYL

SEQ ID NO: 628 - protein, 102 aa, Artificial sequence
  G29W/M56T/L98Q/Y105L IgV domain
HVAQPAVVLASSRGIASFVCEYASPWKATEVRVTVLRQADSQVTEVCAATYMTGNELTFLDDSICTGTSSGNQVNLTIQGLRAMDTGLYICKVEQMYPPPYL

SEQ ID NO: 629 - protein, 102 aa, Artificial sequence
  L12F/G29W/L98Q/Y105L IgV domain
HVAQPAVVFASSRGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 630 - protein, 102 aa, Artificial sequence
  L12F/L98Q/Y105L IgV domain
HVAQPAVVFASSRGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 631 - protein, 102 aa, Artificial sequence
  R16H/L98Q/Y105L IgV domain
HVAQPAVVLASSHGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 632 - protein, 102 aa, Artificial sequence
  G29W/L98Q/Y105L IgV domain
HVAQPAVVLASSRGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 633 - protein, 102 aa, Artificial sequence
  M56T/L98Q/Y105L IgV domain
HVAQPAVVLASSRGIASFVCEYASPGKATEVRVTVLRQADSQVTEVCAATYMTGNELTFLDDSICTGTSSGNQVNLTIQGLRAMDTGLYICKVEQMYPPPYL

SEQ ID NO: 634 - protein, 102 aa, Artificial sequence
  L12F/R16H/G29W/M56T/S72G/L98Q/Y105L IgV domain
HVAQPAVVFASSHGIASFVCEYASPWKATEVRVTVLRQADSQVTEVCAATYMTGNELTFLDDSICTGTGSGNQVNLTIQGLRAMDTGLYICKVEQMYPPPYL

SEQ ID NO: 635 - protein, 102 aa, Artificial sequence
  G29W/M56T/S72G/L98Q/Y105L IgV domain
HVAQPAVVLASSRGIASFVCEYASPWKATEVRVTVLRQADSQVTEVCAATYMTGNELTFLDDSICTGTGSGNQVNLTIQGLRAMDTGLYICKVEQMYPPPYL

SEQ ID NO: 636 - protein, 126 aa, Artificial sequence
  I18T, T61R, L63P, S72G, L98Q, M99L, P102L, Y105L ECD
KAMHVAQPAVVLASSRGTASFVCEYASPGKATEVRVTVLRQADSQVTEVCAATYMMGNELRFPDDSICTGTGSGNQVNLTIQGLRAMDTGLYICKVEQLYPLPYLLGIGNGTQIYVIDPEPCPDSD

SEQ ID NO: 637 - protein, 102 aa, Artificial sequence
  I18T, T61R, L63P, S72G, L98Q, M99L, P102L, Y105L IgV domain
HVAQPAVVLASSRGTASFVCEYASPGKATEVRVTVLRQADSQVTEVCAATYMMGNELRFPDDSICTGTGSGNQVNLTIQGLRAMDTGLYICKVEQLYPLPYL

SEQ ID NO: 638 - protein, 231 aa, Artificial Sequence
  Fc with C220S/E356D/M358L/K447del
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

What is claimed:

1. A variant CTLA-4 polypeptide, comprising an IgV domain or a specific binding fragment thereof, wherein the variant CTLA-4 polypeptide comprises one or more amino acid modifications in an unmodified CTLA-4 polypeptide or a specific binding fragment thereof corresponding to position(s) selected from among 29, 53, 56, 58, 82, 87, and 98, with reference to positions set forth in SEQ ID NO:2 and wherein the sequence includes L63P and Y105L.

2. The variant CTLA-4 polypeptide of claim 1, wherein the unmodified CTLA-4 polypeptide comprises (i) the sequence of amino acids set forth in SEQ ID NO:2, (ii) a sequence of amino acids that has at least 95% sequence identity to SEQ ID NO:2; or (iii) a portion of (i) or (ii) comprising an IgV domain or specific binding fragment of the IgV domain.

3. The variant CTLA-4 polypeptide of claim 1, wherein the variant CTLA-4 polypeptide specifically binds to the ectodomain of human ICOSL, human CD80 and/or human CD86 with increased affinity compared to the binding of the unmodified CTLA-4 polypeptide for the same ectodomain(s).

4. The variant CTLA-4 polypeptide of claim 1, wherein the one or more amino acid modifications are selected from G29W, T53 S, M56K, N58S, Q82R, M87V, and L98Q.

5. The variant CTLA-4 polypeptide of claim 1, consisting of one or more amino acid modifications selected from among G29W/N58S/L63P/Q82R/L98Q/Y105L,
T53S/L63P/Y105L, and
M56KN58S/L63P/M87V/L98Q/Y105L.

6. The variant CTLA-4 polypeptide of claim 1, wherein the variant CTLA-4 polypeptide specifically binds to the ectodomain of human ICOSL with increased affinity and specifically binds to the ectodomain of one or more of the other of human CD80 or human CD86 with decreased affinity compared to the binding of the unmodified CTLA-4 for the same ectodomains.

7. The variant CTLA-4 polypeptide of claim 1, comprising the sequence of amino acids of the extracellular domain set forth in any of SEQ ID NOS: 93, 579, and 586, or a specific binding fragment thereof.

8. The variant CTLA-4 polypeptide of claim 1 that is a soluble protein; wherein the variant CTLA-4 polypeptide lacks the CTLA-4 transmembrane domain and intracellular signaling domain; and/or the variant CTLA-4 polypeptide is not capable of being expressed on the surface of a cell.

9. The variant CTLA-4 polypeptide of claim 1 that is linked to a multimerization domain.

10. A variant CTLA-4-Fc fusion protein, comprising the variant CTLA-4 polypeptide of claim 3.

11. The variant CTLA-4 Fc fusion protein of claim 10, wherein the Fc domain is a variant Fc domain with reduced effector function.

12. An immunomodulatory polypeptide, comprising the variant CTLA-4 of claim 3 linked to a second polypeptide comprising an immunoglobulin superfamily (IgSF) domain.

13. A conjugate, comprising the variant CTLA-4 of claim 1 linked to a moiety that specifically binds to a molecule on the surface of a cell.

14. A nucleic acid molecule, encoding the variant CTLA-4 polypeptide of claim 3.

15. A vector, comprising the nucleic acid molecule of claim 14.

16. A cell, comprising the nucleic acid of claim 14 or a vector comprising the nucleic acid molecule of claim 14.

17. A method of producing a variant CTLA-4 polypeptide or an immunomodulatory protein, comprising introducing the nucleic acid molecule of claim 14 or a vector comprising the nucleic acid molecule of claim 14 into a host cell under conditions to express the protein in the cell.

18. A method of engineering a cell expressing a variant CTLA-4 polypeptide, comprising introducing a nucleic acid molecule encoding the variant CTLA-4 polypeptide of claim 1 into a host cell under conditions in which the polypeptide is expressed in the cell.

19. An engineered cell, expressing the variant CTLA-4 polypeptide of claim 3 or a nucleic acid molecule encoding a sequence of amino acids comprising the variant CTLA-4 polypeptide of claim 3.

20. A pharmaceutical composition, comprising the variant CTLA-4 polypeptide of claim 1 and a pharmaceutically acceptable excipient.

21. An article of manufacture comprising the pharmaceutical composition of claim 20 in a vial or container.

22. A kit comprising the pharmaceutical composition of claim 20, and instructions for use.

23. A method of modulating an immune response in a subject, comprising administering the pharmaceutical composition of claim 20 to the subject.

24. A method of treatment, comprising administering to a subject that has a disease or condition the pharmaceutical composition of claim 20.

25. The variant CTLA-4 polypeptide of claim 1, comprising SEQ ID NO: 93.

26. The variant CTLA-4 polypeptide of claim 1, comprising SEQ ID NO: 579.

27. The variant CTLA-4 polypeptide of claim 1, comprising SEQ ID NO: 586.

28. The variant CTLA-4 polypeptide of claim 1, comprising SEQ ID NO: 238.

29. The variant CTLA-4 polypeptide of claim 1, comprising SEQ ID NO: 375.

30. The variant CTLA-4 polypeptide of claim 1, comprising SEQ ID NO: 612.

31. The variant CTLA-4 polypeptide of claim 1, comprising SEQ ID NO: 619.

* * * * *

UNITED STATES PATENT AND TRADEMARK OFFICE

CERTIFICATE OF CORRECTION

PATENT NO. : 11,753,458 B2
APPLICATION NO. : 16/755072
DATED : September 12, 2023
INVENTOR(S) : Lawrence Evans et al.

It is certified that error appears in the above-identified patent and that said Letters Patent is hereby corrected as shown below:

In the Claims

At Column 167, Claim number 4, Line number 51:
"G29W, T53 S, M56K, N58S, Q82R, M87V, and L98Q." should read --G29W, T53S, M56K, N58S, Q82R, M87V, and L98Q.--

At Column 167, Claim number 5, Line number 57:
"M56KN58S/L63P/M87V/L98Q/Y105L." should read --M56K/N58S/L63P/M87V/L98Q/Y105L.--

At Column 168, Claim number 10, Line number 37:
"variant CTLA-4 polypeptide of claim 3." should read --variant CTLA-4 polypeptide of claim 1.--

At Column 168, Claim number 12, Line number 42:
"variant CTLA-4 of claim 3 linked to a second polypeptide" should read --variant CTLA-4 of claim 1 linked to a second polypeptide--

At Column 168, Claim number 14, Line number 48:
"CTLA-4 polypeptide of claim 3." should read --CTLA-4 polypeptide of claim 1.--

At Column 168, Claim number 19, Line number 65:
"polypeptide of claim 3 or a nucleic acid molecule encoding" should read --polypeptide of claim 1 or a nucleic acid molecule encoding--

At Column 168, Claim number 19, Line number 67:
"polypeptide of claim 3." should read --polypeptide of claim 1.--

Signed and Sealed this
Fifth Day of December, 2023

Katherine Kelly Vidal

Katherine Kelly Vidal
*Director of the United States Patent and Trademark Office*